United States Patent 11,723,967 (ZIKA VIRUS VACCINE) - sequence listing, part 6

SEQ ID NO: 6987 - RNA, 2524 nt, Artificial Sequence
  KU527068.1 prME-long mRNA Design 2 opt
ggggcgcugccuacggagguggcagccaucuccuucucggcaucaagcuuaccaugagaauaauaaaugcgagaaaggaaaaaaaacgacgaggagcagauacaucaguuggaauaguaggcuuauuauuaacaacggcaauggccgcagaagugacaagaagaggaagugcauauuacauguauuuagauagaaacgaugcuggagaagcuauaucuuuuccaaccacauuaggaaugaauaaauguuacauacaaauaauggauuuaggucauaugugugaugcuacaaugucauaugaguguccaauguuagaugaagguguagaaccugaugacguagauuguuggugcaacacaacaaguacauggguaguauauggaacaugucaucauaaaaaaggagaagccagaagaagcagacgugcuguaacauuacccucacauagcacaagaaaacuacaaacccgaagucaaacgugguuagaaucuagagaauacacaaaacaucuuauaagaguagagaauuggauauuuagaaauccugguuucgcauuggcagcagcagcaauugcguggcuacuaggaucgucuacaagucaaaaaguaauauacuuaguaaugauauuacuuauagcgccugcauauaguauaagauguauaggaguaagcaauagagauuuuguagaagguaugucaggggguacguggguagauguaguauuagaacaugguggaugcgucacaguaauggcacaagacaaaccuacaguagauauugaacuaguaacaacaacaguaucaaauauggccgaaguaagaucauauuguuaugaagcaucuauaagugauauggcuagugacaguagauguccaacacaaggugaagcauaucuagauaaacaaagcgauacacaauauguguguaaaagaacauuaguagauagaggaugggguaacggaugugguuuauuuggaaaaggauccuuaguaacgugugcaaaauuugcuuguagcaaaaaaaugacaggaaaaucaauccaaccagaaaauuuagaauauagaaucauguuguccgugcaugguagucaacacucuggaaugauuguaaaugauacaggacaugaaaccgaugaaaauagagcaaaaguugaaauaacaccgaauagcccaagggcagaagccacauuaggaggauuuggcucguuaggucuagauugugaaccaagaaccggauuagauuuuagugaccuauauuaucuaacuaugaacaacaaacacugguuaguucacaaagaaugguuucacgauauacccuuacccuggcaugcuggggcagacacagguacaccacauuggaauaauaaagaagcacuuguagaauucaaagacgcucaugccaagagacaaacuguaguugugcucgguagucaggaaggugcuguacacacagcacuugcaggagcacuugaagcagaaauggauggagcaaaggguagauuaucuaguggucauuuaaaauguagauuaaaaauggacaaauuaagauuaaaaggcguaaguuauucacuauguacugcagcauuuacauuuaccaaaauaccagcagaaacacuacauggaacugucacaguagaaguacaguaugccggaacagaugguccauguaaagugccggcucaaauggcaguugauaugcaaacauuaacaccaguaggaagauuaauaacagcaaauccgguuauuacagagucuacggaaaauucgaaaaugaugcuugaacuagacccaccauucggugacaguuacauugucauugguguaggugaaaaaaaaauaacacaccauuggcauagaucaggaaguacaauaggaaaagcauuugaagcuacagugagaggagcgaaacgaauggcaguacucggugauacagcaugggauuuuggaucuguagguggagcauuaaauaguuuaggaaaagguauacaucaaauauuuggagcagcuuuuaaaucacuauuuggaggaaugucaugguuuucucaaauucucauagguacacuauuaauguggcuaggccuaaauacaaaaaacggaagcauaaguuuaauguguuuagcuuuaggagguguuuuaauuuuuuuaaguacagcgguaucagcagauguaggauguucaguugauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6988 - RNA, 2524 nt, Artificial Sequence
  KU720415.1 prME-long mRNA Design 2 opt
ggggcgcugccuacggagguggcagccaucuccuucucggcaucaagcuuaccaugagaauaauaaaugcaagaaaagagcgaaaacguagaggagcagauacaagcauuggaaucauagguuuacuauugacaacagcaauggcugcugaaauaacuagaagaggcuccgccuauuauauguaccuagacaggucagacgcagguaaagccauaagcuuugcaacaacauuaggcguaaauaaaugucauguacaaauaauggauuuaggacauaugugugacgcuacaaugaguuaugaauguccaauguuagaugaaggaguggaaccagacgauguugauuguugguguaauaccacuaguacauggguaguauaugguacgugucaccacaaaaaaggcgaagcaagaagauccagaagagcggucacauuaccaucacauucaacuagaaaacuacaaacaagaucccaaacauggcuugaaagcagagaguacacuaaacaccuaauaaaaguagaaaauuggauauucagaaacccuggauuugcauugguagcaguagcaauagcaugguuauuaggaaguagcaccucacaaaaaguaauauaucuaguaaugauucuacuaauugcaccagcauauucaauaagaugcauagguguuuccaauagagauuuuguagaaggaaugucaggaggaacauggguagacgucguccuagaacacggugggugcguaacuguaauggcacaggauaaaccaacuguagauauagaauuaguaacaacaacuguaucuaauauggcagaaguaagaucauauuguuacgaagcaucaauaucugauauggcaagugauuccagaugcccaacacaaggagaagcauauuuagauaaacaaucagauacacaauauguuuguaaaagaacccuggucgaucgagguugggguaauggauguggucuuuuugguaaaggaagccuaguaacaugugcaaaauuuacauguagcaaaaaaaugacaggaaaaucuauacaaccagaaaaucuugaauauagaauaauguuaaguguucauggaagccaacauucaggcaugauagugaaugauacagguuaugaaacagaugaaaacagggcgaaaguagaaguaacaccaaacucaccacgagcagaagccacuuuaggaggauucggaucauuaggacuagacugugagccaagaacaggauuggauuuuagugaucuauacuauuuaacaaugaauaauaaacacugguuaguacacaaagaaugguuccaugacauaccauuaccuuggcacgccggagcagacacaggaacaccccacuggaauaauaaagaagcgcuaguagaauuuaaagaugcacacgccaaaagacaaacugucguaguauuaggaucacaagaaggugcaguacauacagcucucgcaggagcauuagaagcagaaauggacggagccaaagguaaacuuuuuucaggacauuuaaaauguagauuaaaaauggauaaauugcgacuaaaagguguaagcuauucacuauguacagcagcauuuacauucacaaaaguacccgcagaaacacuacauggaaccgugacaguagaaguucaauaugcaggaacagauggcccauguaaaauaccuguacaaauggcaguagauaugcaaacacuaacucccgucggcagauuaauuacagcaaauccaguaauaacugaaaguacagaaaauucaaaaaugaugcuagaauuagauccgccauucggagauucauacauaguuauuggcgugggagacaaaaaaauuacacaucacuggcauagaagcggaaguaccauaggaaaagcuuuugaagcaacaguucgaggagcaaaaagaauggcaguauuaggugacacugccugggauuucgguuccguaggaggaguuuucaauucauuaggcaaagguauucaccaaauauuuggugcggcauucaaaucauuauuuggagguaugucaugguuuagucaaauacuaauaggaacauuacuaguaugguuaggauuaaauacaaaaaacggguccauaucuuuaacauguuuagcucuagguggcguuaugauauuuuuaaguacugcaguaagugcagauguuggcugcucagucgauuuuucuaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6989 - RNA, 2506 nt, Artificial Sequence
  DQ859059.1 prME-long mRNA Design 2 opt
ggggcgcugccuacggagguggcagccaucuccuucucggcaucaagcuuaccaugagaauaauaaaugcaagaaaagaaagaaaaagaagaggggcugauacaaguauagguauaguaggacugcuauuaacaacggcaauggcugcagaaauaacaaggaggggaucagcauauuacauguaucuagauagaucugaugcgggaaaagcaauaucuuuugcgacaacuuuaggaguaaauaaaugccauguacagauaauggauuuaggacauaugugcgaugcgacuaugaguuaugaaugcccaauguuagacgaagggguugaaccagacgacgucgauuguugguguaauacaacgaguacuuggguaguauauggaacaugccaucacaagaaaggcgaagcaagaagaagcagacgagcgguaacauuaccaucacauucaacaagaaaacuacaaacaaggucacaaacauggcuagaaagcagagaauauacaaaacauuuaaucaaaguagaaaauuggaucuucagaaauccagguuuuacucuaguagccgucgcaauugcaugguuauuaggaaguaguacaucacaaaaaguaauauauuuaguaaugauacuauuaauagcgccagcauauaguaucagauguauaggaguaagcaauagagauuuuguagaaggaaugucaggagguacauggguagacgugguacuugaacauggagguuguguuacuguaauggcacaagauaagccgacuguagauauagaauuaguuacaacaacuguaaguaauauggcagaaguucgaaguuauuguuacgaagcaucgauaagugauauggcaucagacucaagauguccuacacaaggugaagcauaucuagacaaacaaucagauacacaauacguauguaaaagaacauuaguagaucguggguggggaaauggaugcggauuguuuggaaaaggaagccuaguaacaugcgcuaaauuuaccuguaguaaaaagaugacuggaaaaucaauucagccggaaaaccuagaauacagaauaaugcuaucaguacacggaagucagcauucagguaugaucguaaaugacgaaaauagagcuaaaguagaagugacgccuaacaguccaagagcagaagcuacgcuaggagguuuugggagucucggauuagauugugaaccuagaacaggauuggauuuuagcgauuuauacuacuuaacuaugaauaauaaacauuggcuuguacauaaggaaugguuucaugacauaccauuaccauggcaugcaggagcagauacagguacaccccauuggaauaauaaagaagcucuaguugaguucaaggaugcacaugcuaaaagacaaacagucguaguauuggggucacaagaaggugcaguacauacagcucuugcuggagcacuagaagcugaaauggauggagcuaaaggaagacuguuuaguggucauuuaaaaugucgauuaaaaauggacaaauuaagauugaaagggguaagcuacucuuuauguacugcagcauucacguucacuaaaguaccggcugaaacauuacauggaacaguaacaguagaaguacaauaugcggguacagauggaccauguaaaguaccagcucaaauggcgguagauaugcaaacacuaacaccaguugggagauugauaacagcgaacccaguaauaacggaaaguacagaaaauaguaaaaugauguuggaacuugacccaccauucggagauaguuauauaguuaucggaguaggagauaagaaaauuacacaucauuggcauagaaguggaaguacaauugggaaagcauuugaagccacuguuagaggggcaaaaaggauggcaguuuuaggagauacagcaugggacuuuggaagcguaggcgguguuuuuaauagucuagguaaagggauacaucaaauauuuggugcagcauucaaaaguuuauuuggagggaugucaugguucagucaaauucuaauugguacacuauuaguaugguuaggucuaaauacgaaaaauggaaguauuucauugacaugucuugcauuagguggaguaaugauuuuccuaaguacagcuguuagugcagaugugggauguaguguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6990 - RNA, 2524 nt, Artificial Sequence
  KX377335.1 prME-long mRNA Design 2 opt
ggggcgcugccuacggagguggcagccaucuccuucucggcaucaagcuuaccaugagaauaauaaacgcuagaaaagaaagaaaaagaagaggagcagauacauccauaggaauaauaggauuacuucucacaacagcgauggcagcagaaaucacaagacgcggaagugcauacuauauguaucuagauagauccgaugcaggaaaggcgauaucauuugcaacgacauuaggcguuaauaaaugucauguacaaauuauggauuugggccacaugugugaugcuaccaugaguuacgaauguccuaugcuagaugaaggaguagaaccugaugauguggauuguuggugcaacacaacaucaacaugggugguuuaugguacuugccacagaaagaaaggugaagcaagaagaagcagacgagcaguaacacuuccaucccauucaacacggaaacuacaaacaagaucacaaacaugguuagaaucuagagaauacacaaaacaucuuauaaaaguagaaaauuggauuuuuagaaacccaggauuugcauuaguagcuguugcuauagcauggcuucuagguucaucaacaucacaaaaaguaauuuauuuaguuaugauauuauuaauagcuccagcauauaguauuagauguauuggaguaucgaauagagauuuuguugaagguaugaguggaggcacauggguggacgucguauuagaacacgggggauguguaacaguaauggcacaagacaaaccaacaguugacauagagcuaguaacuacaacaguaaguaacauggcagaaguaagaagcuauuguuaugaagccaguaucagugacauggcaagugacaguagauguccuacacaaggagaggcuuauuuagauaaacaaagugauacacaguauguauguaaaagaacauuaguagauagagguuggggaaauggcuguggacucuuuggaaaaggaucgcuaguaacaugugcaaaauuuacauguucaaagaaaaugacuggaaaaucaauucaaccagaaaacuuggaauaccgaauaaugcuaagcgugcauggaucccaacauagcgggaugauaguaaacgauacaggauaugaaacugacgaaaacagagcaaaaguagaaguaacuccaaauaguccaagagcagaagcaaccuuaggaggauuugguucuuuaggacuagauugcgaacccagaacaggauuagacuuuagugaccuuuauuauuuaaccaugaauaacaaacauuggcuaguucauaaagaaugguuucaugauauaccauuaccauggcaugcaggcgcagauacuggcacuccacauuggaacaauaaagaagcgcuaguagaauuuaaagacgcucaugccaagagacaaacaguggucguacuuggaagccaagaaggcgcagugcauacagcucuagcaggagcacuagaagcagaaauggauggugcaaaaggaaaguuauuuaguggacauuuaaaauguagacuaaaaauggauaaauuaagauuaaaaggagucagcuacucgcucugcaccgcagcauuuacauuuacaaaaguaccagcagaaacauuacauggaacaguuacaguugaaguacaauaugcagguacagauggaccauguaaaauaccaguucaaauggcuguagacaugcaaacauuaacgccuguagggagacuaauaacagcaaauccagucauaacggaaucaacagaaaacaguaaaaugaugcuagaacucgacccuccauucggagacucauacauaguaauuggaguuggagacaagaaaauuacucaccauuggcacagaucagggucaacaauaggaaaagccuucgaagcaacuguaagaggagcuaaaagaauggcuguauuaggcgacacagcaugggauuuuggauccgucggaggaguauuuaauagcuuaggaaaaggaauacaccaaauauuuggagcggcuuuuaaaucacuuuuuggcggaaugucaugguuuucacaaauacuuauaggaacucuauuaguaugguuaggccuaaauacuaaaaauggaaguauaucauuaacaugucuagcauuaggaggagucaugauauucuuaagcacagcaguaagugccgacguaggaugcucaguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6991 - RNA, 2524 nt, Artificial Sequence
  LC002520.1 prME-long mRNA Design 2 opt
ggggcgcugccuacggagguggcagccaucuccuucucggcaucaagcuuaccaugagaauaauaaaugcaagaaaagaaagaaaaaggagaggugccgauacgucuauagguauaauaggauuauuacuaacuacagcaauggcggcagaaauaacacgaagaggaagugcguacuacauguaucuagacagaagugacgcaggaaaagcaauuagcuucgcaacaacacuugguguaaauaaaugucauguccaaauaauggauuuaggacauaugugugaugccacaaugucauaugaauguccaaugcuagaugaaggaguggagcccgaugacguugacuguugguguaauacaacaagcacuuggguaguauaugguacuugccaucauaagaaaggugaagccagaagaagcagacgagcaguuacauuaccaucacacagcacuagaaaauuacaaacaaggagucagacuugguuagaaagucgagaauacacaaaacaccuaauuaaaguagaaaauuggauauuuagaaacccuggcuucgcauuaguagcaguugcaauagcauggcuacuagguaguaguacaagucagaaaguaauuuauuuagucaugauccuauugauagcaccagcauauucaauaagauguauugggguuucaaauagagauuucguagaggggaugaguggcggaacauggguagacguaguauuagaacauggaggcuguguuacgguaauggcgcaagauaaaccaacugucgauauagagcuaguaacaacaacaguaucaaauauggcagagguaagaucuuacuguuaugaggcaaguauaagugauauggcaucagacaguagauguccuacacaaggagaagcauauuuagauaaacaaucggauacacaauauguauguaaaaggacgcuaguagaucgaggauggggaaacggauguggauuauucggaaaaggaaguuuaguuacaugcgcaaaauucacauguucaaagaagaugacaggaaaaucaauacaaccagaaaaccuagaauacagaauaauguuaucuguacacggaagucagcauucaggaaugacaguaaaugacauaggauacgagacugaugaaaauagagcuaaaguagaaguaacuccaaauucaccgagagcagaagcuacauuaggaggauuuggaagucuaggacuagacugugaaccucgaacagguuuagauuuuagugauuuauauuacuuaacaaugaacaacaaacacuggcuaguucauaaagaaugguuucaugacauaccauuacccuggcacgcuggugccgauacaggaaccccacauuggaacaauaaagaagcauuaguagaauuuaaagaugcacaugcaaaaagacaaacaguaguagucuuggguucacaagaaggcgccguacauacggcauuagcaggggcuuuagaagcagagauggauggcgcaaaagguaaauuauuuucgggacaccuaaaaugcagauuaaaaauggauaaauuacgauuaaaaggaguaucauauucacuauguacagcagcauuuacauuuacaaaaguaccagcugaaacucugcacggaacagugacgguagaaguucaauacgccgguacagauggaccaugcaaaauaccuguacaaauggcuguagauaugcaaaccuuaacaccaguaggaagauuaauuacugcaaauccaguaauuacagagagcaccgagaauagcaaaaugaugcuagaauuagauccaccuuuuggugauucauauauaguaaucgguguuggagauaagaaaauaacacaccacuggcauagaucaggaucaacaauagguaaagcauucgaagcaacaguaagaggcgcaaaacgaauggcuguacuaggugauacagcuugggauuuuggaucaguaggaggaguauuuaacagucuaggaaaaggaauacaucagauuuuuggggcagcauucaaaaguuuauuuggaggcaugagcugguucagucaaauauuaauuggaacacuuuuaguauggcuaggauuaaauacgaaaaaugguaguauaagucugacaugucuagcauuaggugguguaaugauauuucuuagcacagcggucagcgcagauguaggauguucuguggacuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6992 - RNA, 2512 nt, Artificial Sequence
  KU963573.2 prME-long mRNA Design 2 opt
ggggcgcugccuacggagguggcagccaucuccuucucggcaucaagcuuaccaugcgcauaauaaaugccagaaaagaaagaaaaaggagaggugcagauacauccauaggaauaauaggacuguugcuaacgaccgcaauggcagcagaaauuacaaggaggggcucagcauauuauauguaucuagauaggucugaugcaggaaaagcaauaaguuuugcaacaacacuagggguaaauaaaugccauguucaaauaauggauuuaggacauaugugugaugcaacaaugaguuacgaaugcccuaugcuagacgaaggaguggaaccggacgacgucgauugcugguguaauacaacuucaacauggguuguauaugguacuugccaucauaaaaaaggagaagcaagaagaagccgaagagcaguaacacuaccaagccauagcacucgaaaauugcaaacaagaucucagacauggcuagaaucaagagaauauacaaaacauuuaaucaaaguagaaaauuggauauuuagaaauccaggauucgcccuaguagcaguggcaauagcaugguuauuaggaucuucaacaagucaaaaagucauauauuuagugaugauuuugcuaauagcuccagcauauucuauaagauguauaggaguaucaaacagagacuuuguugaaggaaugaguggcggaacauggguagauguaguauuagaacauggaggaugugugacaguaauggcucaagauaaaccaacuguugauauugaacuuguaacaacaacaguaucuaacauggcugaaguaagaaguuauuguuaugaggcuucuauaucagauauggccucagauaguaggugcccuacacaaggagaagcauacuuagauaaacaaagugacacacaauacguauguaaacgaacuuuaguagauagagguuggggaaauggcuguggucuauuuggaaaaggaagucuaguaacaugugcaaaauuuacauguucaaaaaaaaugacuggaaaaucaauucaaccagaaaauuuagaguauagaauaaugcuaucaguacauggaagucaacacagugggaugauaggauacgaaacagacgaaaauagggccaaaguagaaguaacaccgaacucuccaagagcggaagcgacauuagggggauucggaucauuaggauuagauugugaaccaagaacaggauuagauuuuagcgaucuauauuacuuaacaaugaauaacaaacauuggcuaguacauaaagaaugguuucaugauauaccucuaccauggcaugcaggagcagauacugguacgccacauuggaacaauaaagaagcauugguagaauuuaaagaugcacaugcuaagaggcaaacgguuguaguacucggaucacaagaaggagcaguacauacugccuuagcuggugcacuagaagcagaaauggauggugcaaaaggaaaacuauuuaguggacauuuaaaaugucgacuaaaaauggacaaacuaagacuaaaaggaguuucauauucuuuaugcacagccgcauuuacauucacaaaagucccagcagaaacacuucacggaacagugacaguugaaguacaauaugcaggaacggauggaccguguaaaauaccuguacaaauggcaguagauaugcaaacacuaacaccaguaggaagauugauaacagcaaacccaguaauaacagaaucaacagaaaacucaaaaaugauguuagaguuggauccgccauucggagauaguuauauuguuauaggaguaggcgacaagaaaauaacucaucauuggcauagaucaggaagcacuauagguaaagcguucgaggcaacggugagaggggcuaaaagaauggcaguauuaggagauacagcaugggauuuuggaaguguaggaggaguauucaacucacuaggaaaaggaauacaucaaauauuuggagcagcuuuuaaaucacuauucgguggcaugagcugguuuucacaaauauuaauaggcacacuauuaguaugguuaggacuaaacacaaaaaauggaaguauaagucuaacauguuuagcacuaggaggaguaaugauauuucuaucaacagcagugagugcugauguagguugcaguguugauuucucgaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6993 - RNA, 2524 nt, Artificial Sequence
  KX694534.2 prME-long mRNA Design 2 opt
ggggcgcugccuacggagguggcagccaucuccuucucggcaucaagcuuaccaugagaauaauaaaugcaagaaaagaaaagaaaagacguggagcugauacaucaguaggaauaguaggauuacuauuaacaacugcgauggccgcagagguaacacgaagaggaucagccuacuauauguaucuggacagaaaugaugcaggagaagcaauaaguuuuccaacuacauuagguaugaauaaauguuauauacaaauuauggacuuaggacauaugugcgaugcuacaaugucauacgaaugcccaauguuagaugaagguguagaacccgacgauguugauuguugguguaacacaacaaguacauggguaguuuacgggaccugucaccauaagaaaggagaagcgagaagaucaaggagagcagucacucugccaagccacucuacaagaaaauugcaaacaagaagucaaacauggcuagaaaguagggaauacacaaaacauuuaaucagaguagaaaacuggauauuuaggaauccaggcuuugcacuagcagcagcagcaaucgcuugguugcuagguagcaguacaagucagaaaguaauauauuuaguaaugauuuuauuaauagcaccagccuauucaauucgauguauaggugucagcaauagagauuuuguagaaggaaugucuggcggaacauggguugauguaguacuugaacauggaggaugugugacaguaauggcucaagacaaaccaacuguagacauagaauuaguaaccacuacuguaaguaauauggcagaaguaagaaguuauuguuaugaggcuucaauaucagauauggcaucagacucaagauguccaacacaaggagaagcauaucuugacaaacaaucagauacgcaauauguauguaaaagaacucuagucgauagaggaugggguaacggauguggauuauucggaaaagguagcuugguaacuugugcaaaauuugcauguaguaagaaaaugacagggaaaaguauacaacccgaaaaucuagaauaucgaauaauguuaagugugcauggaucgcaacauaguggaaugauaguaaaugauacaggacaugaaacagaugaaaauagagcuaaaguagaaauaacaccaaauucaccgagagcagaagcaaccuuaggaggguuuggaaguuugggauuagauugugaacccagaacaggcuuagacuuuucagaucuauauuaccuaacuaugaacaauaaacauugguuaguacauaaagaaugguuucaugauauaccuuuaccauggcaugcaggagcagauacugguacaccgcauuggaauaauaaagaagcauuagucgaauuuaaggaugcacacgcaaaaagacaaacaguaguaguacuaggaucucaggaaggcgcagugcauacagcacucgcuggugcauuagaagcagaaauggauggagcaaaaggaagauuaagcucgggacaucuaaaauguagauuaaaaauggacaaauugagauuaaaagguguaagcuacaguuuaugcacagccgccuucacauucacaaaaauaccugcagaaacauuacauggaaccguuacgguagaaguacaauacgcaggaacagauggaccauguaaagucccagcacaaauggcaguagauaugcaaacauuaacaccaguagguagauugauaacugcaaauccaguaauuacggaaucgacagaaaauaguaaaaugaugcuagaauuagauccaccauucggcgauaguuauauaguaauaggaguuggagagaaaaagauaacacaucacuggcaucgaagugguucaacaauaggcaaagcauucgaagcaacagucagaggagcaaaaagaauggcuguauuaggcgacacagcgugggacuucggaaguguagguggagcacuaaauucauuaggaagaggaauacaucaaauauuuggagcagcauuuaaaucacuauuuggagguaugagcugguuuagucaaauauuaauuggaacauuauuaaugugguuaggacuaaauacuaaaaaugguucuauaaguuuaauguguuuagcacuaggaggaguacuaauuuuucucaguacagcuguaucagcagauguugguuguucaguugauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6994 - RNA, 2524 nt, Artificial Sequence
  KX447520.1 prME-long mRNA Design 2 opt
ggggcgcugccuacggagguggcagccaucuccuucucggcaucaagcuuaccaugagaauaauaaacgcacgaaaagagaaaaagagaagaggcgcagaugccagcguaggaauaguaggauuacuacuaacaacugcaauggcagccgaagucacucgaagaggaagugcauauuauauguauuuagauaggaaugaugcaggggaagcaauaucauuccccacaacauuaggaaugaauaaaugcuacauacaaauaauggauuuaggacauaugugugacgcaacgaugucauacgaauguccuauguuagacgagggaguugaaccagaugacguagauugcuggugcaauacaacaucaacauggguuguauauggcacuugucaccauaagaaaggagaagcgagaagaucuaggagagcaguaacacuaccaucacauaguacgagaaaacuacaaacaagaucucaaacaugguuagaaucaagagaauauacaaaacacuuaauaagaguagaaaacuggauauucagaaacccaggauucgcauuagcagcagcagcaauugcgugguuacuaggaaguaguacaagccaaaaaguuauauaucuugucaugauucuauuaauagcaccagcauauaguauuaggugcauaggcguuagcaacagagauuucguagaagggaugucaggaggaacauggguagauguuguauuagagcaugggggaugugucaccguaauggcacaggauaaaccuacaguagacaucgaauuaguuacaacaacaguaucaaauauggcagaaguaagaucuuauugcuaugaagcaucaauaucagacauggcuagugauagccgaugcccuacacaaggagaagcauacuuagauaaacaaucagauacacaauauguauguaaaagaacccuaguagauagaggauggggaaauggauguggauuauucggaaaaggaucauugguaacuugugcaaaauuugcauguucaaagaaaaugacuggaaaaagcauacagccugaaaaucuugaauacagaauaaugcuuaguguacacggaucucaacauucagggaugauaguaaacgauacagggcaugaaacagaugaaaauagagcgaaaguagaaauuacaccuaauagucccagagcugaagcaacacuaggaggauucggaagccuaggacuugauugugaaccccguacaggauuagauuuuucagacuuauauuauuugacaaugaacaauaaacauuggcuaguccacaaagaaugguuccacgacauaccgcuacccuggcacgcaggagcggacacugguaccccacauuggaauaauaaagaagcauuaguagaguucaaagaugcacaugcuaaacgacaaacaguaguaguacuuggaagucaagaaggagcaguacauacagcauuagcgggugcacuagaagcagaaauggauggagcaaaaggaagauuaaguagugggcaucuaaaaugcagacucaaaauggauaaacuaagguuaaaaggaguaucauauucauuauguacagcagcuuuuacauuuacuaaaauaccugcagaaacguuacauggaacgguaacugucgaaguacaauaugcuggaaccgacggaccaugcaaaguaccugcacaaauggcaguagauaugcaaacauuaacuccuguaggcagauugauaacugcaaacccugucauaacggaaucaacagaaaauaguaaaaugaugcuugaauuagacccaccauuuggagauaguuauauaguaaucggaguaggggaaaagaaaauaacacaucacuggcacaggucggggucaacaauaggaaaagcguuugaagcaacaguaagaggagcaaaaaggauggcaguauuaggugacacagcuugggauuuuggaagcguagguggugcauuaaauaguuuaggaaaaggcauucaucaaaucuucggagcggcauuuaaaagucuauucggaggaaugucuugguuuucucaaauacuuauuggaacuuuauuaauguggcuaggauuaaauacuaaaaacgguaguauaaguuuaaugugccucgcauugggaggaguauuaauauuucucaguacagcgguaagcgcagacguaggguguagcguagauuucucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6995 - RNA, 2524 nt, Artificial Sequence
  KX369547.1 prME-long mRNA Design 2 opt
ggggcgcugccuacggagguggcagccaucuccuucucggcaucaagcuuaccaugagaaucauaaaugcucggaaggaaaaaaaaagaagaggagccgauacaagcguaggaauaguaggauuacuucuaacgacagcgauggcggcagaggucacaaggagaggauccgcauauuacauguacuuggauagaaaugaugcaggagaagcaauaucauuuccaacaacacuaggaaugaacaaauguuauauacaaauaauggaucuaggacauaugugcgaugcuacaaugucauaugagugcccaauguuggaugaaggaguagagccagaugauguagacuguugguguaacacaacaucaacuuggguuguauacgggacgugucaucauaaaaaaggggaggcgaggaggucgagaagagcaguaacguuaccaucacauagcacaagaaaauuacaaacacgaagucaaaccuggcuagaaaguagagaauauacaaaacauuuaauuagaguagaaaauuggauauuuagaaacccaggauuagcguuagcugcagcagcaauagcauggcuuuuagguagcucgacaagucaaaaaguuauauaucucguuaugauacucuuaauagcaccugcauauaguauaagauguauuggaguaaguaaucgagacuuuguagaagguaugucaggaggaacaugggucgaugugguacuggaacauggaggauguguaacuguuauggcacaagauaaaccaacaguagacauagaguuaguaacaacaaccguaucaaacauggcagaagugcguaguuauugcuaugaagcgucgauaucagacauggcaagugauagccgauguccaacucaaggagaggcauauuuagauaaacaaagugauacucaauauguaugcaaaagaacacuagucgauagagguugggguaacggaugcggauuauucgggaaaggcucauuaguaacuugugcuaaauuugcuuguucaaaaaaaaugacuggaaaaagcauucaaccagagaauuuggaauaucguauaauguuaaguguucauggaucacaacacucagguaugauagucaaugauacaggacaugaaacagacgaaaauagggcaaaaguagaaauaacaccaaauaguccuagagcagaagcaacauuaggcggauuugggaguuuaggcuuagacugugagccaagaacuggauuagacuuuagcgacuuauauuacuuaacaaugaacaacaaacauugguuaguacacaaagagugguuucaugauauaccguuaccauggcaugcaggagcagacacuggaacaccacauuggaauaauaaagaggcauugguagaauuuaaagaugcccaugcgaaacgacaaacagugguaguacuaggaucacaagaaggcgcaguacauacagcacuugcuggcgccuuggaagcagaaauggacggggcuaaagguagauuaaguucaggucauuuaaaauguagauuaaaaauggacaaauuaagauuaaaaggugugucauauucauugugcacagcagcauucacauuuacuaaaauaccagcugaaacauuacacgguacaguaacaguagaaguucaauaugcagguacggacggcccauguaaagucccagcucaaauggcgguagauaugcagacauuaacuccaguugguagacuaauaacagcaaauccuguaaucaccgaaaguacugaaaauucaaaaaugauguuggaacuugauccaccauuuggagauucauauauuguaauagguguaggggaaaaaaaaauaacacaucauuggcacagaaguggaaguacgauuggaaaagccuuugaagcaacgguaaggggugcaaaacgaauggcaguauuaggugauacagcaugggauuuuggcaguguaggaggugcacuaaauucauuaggaaaaggaauacaucaaauauucggagcagcauuuaaaagcuuguuuggugguaugucaugguuuucacaaauacuaauaggaacacuauuaaugugguuaggauuaaauacaaaaaaugggaguauaagucucaugugucuggcauuaggcggaguacucauauuuuuaaguacagcaguuagcgcagauguaggauguaguguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6996 - RNA, 2524 nt, Artificial Sequence
  KX447515.1 prME-long mRNA Design 2 opt
ggggcgcugccuacggagguggcagccaucuccuucucggcaucaagcuuaccaugcgaauaauaaaugcacgaaaagaaaagaaaaggagaggagcugacacuuccguaggcauuguaggauuacucuuaacaacugcuauggcagcugaagucaccagaagagggucagcauauuacauguaucuugauagaaaugacgcaggggaagcaauuagcuuuccaacaacacuuggaaugaauaaauguuacauacaaauaauggaccucggacauaugugcgacgcaacuaugagcuaugaauguccaaugcuagacgaaggaguagaaccagaugacguagacuguuggugcaauacuacaaguacuuggguaguuuaugggacaugccaucauaagaaaggugaagcaagaagaucuaggagagcaguuacauuaccuagucauagcacgagaaaacuacaaacaagaucccaaacaugguuagaaucaagggaauacacaaaacaucuuauaagaguagaaaauuggauauucagaaaucccgguuucgcucuagcagcagcugcuauagcuuggcuauugggaaguagcacuagccaaaaaguaauauacuuaguaaugauacuauuaauagcuccugcauauucuauaagauguauuggaguaaguaacagagacuucguugaaggaaugaguggaggcacauggguagaugucguacuugaacacggaggauguguaacaguaauggcacaagauaaaccgacaguagauauugaauugguaacaacaacagucaguaauauggcagaaguuagaaguuauuguuaugaagcuaguauaagugacauggcaucagauucacgauguccuacacaaggagaggcuuaucuagacaaacagucugauacacaauacguguguaaaagaacuuuaguugaucgaggauggggaaauggauguggacuauuuggaaaaggaucauuaguaacaugugcaaaauucgcauguucaaagaaaaugacaggaaaaagcauacaaccagaaaauuuagaauacagaauaauguuaagugugcauggaucccaacacagcggcaugauaguaaaugauacaggacacgaaacagaugaaaacagagcaaaaguugaaauuacaccaaauaguccacgagcggaagccacacuuggaggguucggaucacuaggacuugacugugaaccaagaacuggauuagauuucucagauuuauauuacuuaacaaugaauaacaaacauugguugguacauaaagaaugguuucacgauauuccgcuaccauggcaugcuggagcagauacagggacaccacauuggaauaacaaagaagcucuaguagaauuuaaagaugcacaugcaaagagacaaacaguaguaguacuaggaagucaggaaggagcaguacauacagcacuagcaggagcucuagaagcugaaauggauggugcaaaaggaagacuaaguagcggacaucuaaaauguagacuaaaaauggacaaacuaagacuaaaggggguuucauauucauuauguacagcagcuuuuacauucacaaaaauaccugcagaaacuuuacaugguacaguaacaguugaaguacaauaugcuggaacagacggacccuguaaaguaccagcacaaauggcaguagauaugcaaacauuaacaccaguuggacgauuaauaacagcaaaucccguuauaaccgaaaguacagaaaauucuaaaaugauguuagaauuagaucccccauucggagacagcuauauagugauuggaguaggagaaaagaaaauuacacaucacugguaccgcucaggaucaacaauaggaaaagccuucgaagcuacuguaagaggugcaaaacgaauggcaguacuaggggacacagcgugggauuucgguucaguaggaggagcacuuaacuccuuagguaaaggcauacaucaaauauuuggagcagcuuuuaaaucucuauuugggggcaugucaugguucucacaaauuuuaaucggcacacuacuaaugugguuaggacuaaauacuaaaaacggaucaauaagucucaugugucuagcccuaggaggaguacuaauauuucuaaguacugcuguaucagccgaugugggaugcaguguagauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6997 - RNA, 2524 nt, Artificial Sequence
  KU501217.1 prME-long mRNA Design 2 opt
ggggcgcugccuacggagguggcagccaucuccuucucggcaucaagcuuaccaugagaauaauuaaugcacgaaaagaaaaaaaaagaagaggagcugauacaaguguaggcauaguagguuuacuguuaacuaccgcuauggcagcagaaguaacgagaagaggaucagcauauuauauguauuuagauagaaaugaugcuggggaagcaauaucauuuccuacaacauuaggaaugaauaaaugcuauauucaaauaauggaucugggacacaugugugaugcaacaaugucauaugaaugccccauguuagaugaagguguagaaccagaugauguagacuguugguguaauacaacaucaacuuggguaguauauggaacaugccaucauaaaaaaggagaagcgagaagaagcagaagagcuguaacauuaccaucacauaguacuagaaaacuacaaacaagaagccaaacauggcuugaaaguagggaauauacuaaacaucuuauaagaguagaaaauuggauauuuagaaauccaggauucgcauuagcagcugcagcuauagcauggcuauuaggaucauccacaagucaaaaaguaauauauuugguaaugauauuacuaauugcaccagcauacucaauaagauguauaggagucaguaauagagauuuuguggaaggaaugagcggaggaacauggguagacguaguuuuagaacacgguggaugcguuacaguuauggcacaagauaaaccaacuguagacauagaauuaguuacaaccacaguaaguaauauggcagagauuagaucauauuguuaugaagcauccauaagcgauauggcaucggauaguagauguccaacacagggcgaagcauaccuagauaaacaaagcgauacgcaauauguuuguaaaagaacgcuaguagauagaggaugggguaaugguuguggacuuuucggaaaaggaagccugguaaccugugcaaaauucgcauguucuaaaaaaaugacaggaaaaucuauucaaccagaaaaucuggaauauagaauaauguuaagcguccauggaagucaacauuccggaaugauuguaaaugauacgggacaugaaacagacgaaaacagagcaaaaguugaaauaacaccaaauuccccaagagcagaagcaacccuaggaggauuuggaucauuaggauuagauugcgaaccuagaacaggacuagacuucucagaccuguauuaccuaacaaugaacaauaaacauugguuaguacauaaagaaugguuccaugauauaccacuaccguggcaugcaggagcugacacuggaacaccccauuggaauaacaaagaagccuuaguagaguuuaaagaugcacacgcaaaacgacaaacaguagucguccuagguagucaagaaggugcuguacauacagcauuagcuggugcucuagaagcagaaauggauggagcuaaaggaagacuaucaaguggacaccuaaaaugccgauuaaaaauggauaaauuaagacuaaaaggaguaaguuacaguuuaugcacagcggcauuuacauuuacaaaaauacccgcagaaaccuuacaugguacaguaaccguagaaguacaauaugcaggcacggauggaccauguaaaguaccagcacaaauggcuguugauaugcaaacacuaacaccgguaggccgauuaauaacugcuaacccaguaaucacagaaaguacugaaaauaguaagaugauguuagaauuggacccaccauuuggagacucauauauaguaaucggcguaggagaaaaaaaaauuacacaucacuggcauagaucaggaaguacaauaggaaaagccuucgaagcaacuguaagaggagcaaagagaauggcaguacuaggagauacagcaugggauuuuggaucgguuggaggagcucucaauagcuugggaaaaggcauacaucaaauauuuggagcagccuuuaaaaguuuguucggaggaaugaguugguuuucucaaauauuaaucgggacacuacuaauguggcugggauuaaauacaaaaaauggcucaauaagucucaugugcuuagcuuuagggggcguuuuaauauuuuuaaguacagcaguaucagcagacguugguugcagcguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6998 - RNA, 2524 nt, Artificial Sequence
  KU312314.1 prME-long mRNA Design 2 opt
ggggcgcugccuacggagguggcagccaucuccuucucggcaucaagcuuaccaugagaauaauaaaugcccgaaaagaaaaaaaacgaagaggagccgacacaaguguaggaaucguaggguuauuacuuacgacggcuauggcggcagaaguaacacgaagaggaagugccuacuacauguacuuggacagaaaugacgcaggagaagcaauaucauuuccaacaacacuagguaugaacaaauguuauauucaaaucauggaucuaggucauaugugugaugccacuaugagcuacgaaugcccaaugcuugaugagggcguagaaccugaugauguggacuguuggugcaacacaacuaguacuugggucguguacggcacaugucaucauaaaaaaggagaagcaagaagaagcaggagagcaguaacguuaccgagccauucaacaagaaaacuacaaacaagaagccaaacaugguuagagagucgagaauauacaaaacacuugauaagaguagaaaacuggauauuuagaaauccagguuucgcauuagcagcagcagcaauugcauggcuauuggguaguuccacaagucaaaaaguaauuuauuuaguuaugauauuauuaauagcucccgcauacucaauaagaugcauaggaguaagcaauagagauuuuguagagggaauguccggaggaacguggguagauguagucuuagaacaugguggauguguaacuguaauggcacaagauaaaccaacuguagauaucgaacuuguaaccacaaccguaucaaauauggcagaaguuagaucguacugcuaugaggccucaauaucagauauggcaucagauucaagauguccaacacaaggugaagcauaucuugacaaacaaucugauacucaauauguauguaaaaggacacuaguagauagagguugggguaauggcuguggacuauuugguaaaggaucucuaguaacaugugcaaaauuugcauguucaaaaaaaaugacaggaaaaaguauacaaccagaaaaucuagaauacagaauaauguuauccguacaugggagccaacauagcggaaugauaguaaaugauacuggacacgaaacagaugaaaaucgagcaaaaguagaaauaacucccaauucaccuagagcugaagcaacccuaggagguuuuggaaguuuaggauuagauugugaaccacgaacaggucuagauuuuucagaucuauauuauuuaacaaugaauaacaaacacugguuaguacauaaagaaugguuucaugauauaccauuaccauggcacgcaggggcagacacaggaacuccccacuggaacaacaaagaagcuuuaguggaauuuaaagaugcacaugcaaaaagacaaacaguaguaguacuaggcucucaagaaggagcugugcauacugcauuagcaggagccuuagaagcagaaauggauggagcaaaagggagauugucaucagggcauuuaaaaugucgacuaaaaauggauaaauuaagauuaaaaggggucagcuauucacuauguacggcagcuuuuacauuuacaaaaauaccagcagaaacacuccaugguacaguaacaguagaaguucaauaugcagguacagauggaccauguaagguucuagcacaaauggcaguagauaugcaaacguuaacuccuguaggaagauuaauaacagccaauccuguaauaacagaaucaaccgaaaauucaaaaaugauguuagaauuagauccuccuuuuggagauucuuauauaguaauagguguuggugaaaaaaaaauaacacaucauuggcauagaaguggaagcacaauagguaaagcauuugaagcaacaguaagaggagcaaaacgaauggcuguacuaggagacacagcuugggauuucggaaguguaggcggagcauuaaauucauuaggaaaggguauacaucaaaucuuuggggcugcauucaaaaguuuauuugguggaaugagcugguucucacaaauucuuaucggaacacuauuaauguggcuaggucuuaauacaaaaaaugggucaauaucuuuaauguguuuagcauuagggggaguacuuauauuccucucaacagccguaucagcagacguuggauguucaguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 6999 - RNA, 2524 nt, Artificial Sequence
  KX446950.2 prME-long mRNA Design 2 opt
ggggcgcugccuacggagguggcagccaucuccuucucggcaucaagcuuaccaugagaauaauaaaugccagaaaagaaaaaaaaagacguggugcugacaccaguguaggaauaguaggauuauuguuaacaacugcaauggcggcagaaguaacaagaaggggaagugcauauuauauguaucuagauagaaacgacgcaggcgaagcaauaaguuucccaacaacauuaggaaugaacaaauguuauauacaaauaauggaccucgggcacaugugcgaugcaacaaugaguuaugaaugcccaacacuagacgaaggaguugaaccggaugacguagauuguuggugcaacacaacaaguacguggguuguauaugguacgugucaucauaaaaaaggugaagccaggaggucaagaagggcaguaacauugccaucccauaguacacggaaauugcaaacaagaucacagacuuggcuugaaagcagagaauauacaaaacauuuaauaagaguagaaaauuggauauuucggaauccaggauuugcauuagcagcugcugcaauugcauggcuucuagguucgucaacaucacaaaaaguaauauauuugguaaugauauuguuaauugcuccagcauauucaauucguuguauagguguaagcaaucgugauuucguagaaggaaugagcggagggacguggguugaugucguguuagaacauggaggguguguaacaguaauggcacaagauaaaccaacaguagauauagaauuaguaacaacuacaguaagcaacauggcagaaguaagaucauauuguuaugaagcaaguauauccgacauggccuccgauaguagaugucccacacaaggugaagcguauuuagauaagcaaucugauacacaauacguaugcaaaagaacacuaguagauagagguuggggaaauggcugcggauuauuuggaaaaggcagucuaguuacaugcgcaaaauuugcauguagcaaaaaaaugacaggaaaaaguauucaaccagaaaacuuagaguauaggauaauguuaucgguacacggaagucaacacucaggaaugauuguaaacgacacgggccacgaaacugacgaaaauagagcaaaaguagaaaucacgccaaauucaccacgagccgaagccacauuaggaggauuuggaucacugggauuagauugcgaaccuagaacgggauuggauuuuagugauuuauauuauuuaacuaugaauaauaaacauugguuaguacauaaagagugguuucaugauauaccucuaccuuggcaugccggggcagauacuggaacuccacauuggaauaauaaagaagcauuaguagaauuuaaagaugcccacgcaaaaagacaaacaguaguuguauuaggaagucaggaaggagcuguacauacagccuuagcaggagcacuagaagcagaaauggauggagcaaaaggaagauuaucaaguggacacuuaaaauguagauuaaaaauggacaaacuaagacuuaaaggugugucauacuccuuauguacagccgcuuuuacuuuuacuaaaauuccagcggagacuuuacaugggacuguaacaguagaaguucaguaugcagguacagaugguccaugcaaaguaccagcccaaauggcaguugauaugcaaacauuaacaccaguaggaagauuaaucacagccaaucccguaaucacagaauccacagaaaauaguaagaugaugcuagaauuagacccaccguuuggagauaguuauauaguaauaggaguuggggaaaagaaaauaacacaucauuggcaccgaagcgguagcaccauaggaaaagcuuuugaagcaacaguuagaggagcuaaaagaauggcaguauugggugauacagcaugggauuucggaucaguagguggagcauuaaacagcuuggguaaaggaauacaucaaauuuucggagcagcauuuaaaagcuuauuuggaggaaugaguugguucucacaaauauuaauaggaacacuauuaaugugguuaggacuaaauacaaaaaauggaaguauaaguuuaauguguuuagcauuagggggaguacuaauauucuuaucaacagcaguaucugcugacguaggaugcucaguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7000 - RNA, 2524 nt, Artificial Sequence
  KY003157.1 prME-long mRNA Design 2 opt
ggggcgcugccuacggagguggcagccaucuccuucucggcaucaagcuuaccaugaggauaauaaaugccagaaaagaaaagaaaaggagaggagcagacacaagcguaggaauaguaggcuuauuauuaacaacagcaauggccgcagagguaacucgaagaggaucagcguacuauauguauuuagauagaaaugaugcaggagaagcaauaucauuuccaacaacauuaggaaugaacaaaugcuacauacaaauaauggauuuagggcauaugugugaugccacuaugaguuaugaaugcccaaugcuagacgaggguguggaaccagaugacguagauuguugguguaacacaacaucuacauggguuguauauggaacuugucaucacaagaaaggagaagcacgaagaagcaggagggcaguaacacuaccaagccauucaacuagaaaacuccaaacaagaagucaaaccugguuagaaucaagagaauauacgaaacaucuaauaagaguagaaaacuggauauuuagaaaucccggauuugcauuagcagcagcagcaaucgccuggcuauuaggaaguucaacaagucaaaaagugauauaucuagucaugauacuacuaauugcaccagcuuauagcauaagauguaucggugucagcaauagagacuucguugaagguaugucagguggaacguggguagacguuguuuuagaacacggcggauguguaacaguaauggcacaagauaaaccaacgguagacauagaacuugugacaacuacuguuaguaacauggcagaaguacgaagcuauugcuaugaagcaucuauaucagauauggcaucagauucacgauguccuacacaaggagaagcauacuuagauaaacaaagcgauacacaauauguuuguaaaaggacauuaguagauagaggcuggggaaaugguuguggauuauuuggaaaagguucauugguaacgugugcaaaauucgcuuguagcaagaaaaugacagguaaaucaauacaaccugaaaacuuggaauacagaauuaugcuaucaguacauggaucacaacauuccggaaugauaguaaaugauacuggucaugaaacagaugaaaaccgagccaaaguagaaauaacaccuaauucuccaagagcagaagcuacauuaggaggauucggaucacuuggucuagauugcgaaccaagaacuggacuugacuuuagugauuuauacuauuuaacaaugaauaauaaacauuggcuaguacauaaagaaugguuucaugacauaccauuaccauggcacgcaggagcagauaccggaacaccacacuggaacaauaaagaagcucuaguagaguucaaagaugcucaugcaaaaagacagaccgugguaguauuaggaucacaagaaggagcuguacauacggcucuagcaggagcacuugaagcggaaauggauggugcaaaaggacgauuaaguucagggcaucuaaaauguagauuaaaaauggacaaauuaagauuaaaaggaguaaguuauaguuuaugcacagccgcuuuuacauuuacuaaaauaccagcagaaacguuacauggaaccguuaccguagaaguacaauaugcaggaacagaugguccaugcaagguaccagcacaaauggcaguagauaugcaaacgcuaacaccaguaggaagguuaaucaccgcuaauccagugauaacagaaucgaccgaaaauuccaaaaugauguuagaauuggauccaccuuuuggagacuccuauauaguaauagggguuggggaaaagaaaauaacccaccauuggcauagaucagggucaacaauaggaaaggcuuucgaggcaaccgugcgaggagcaaaaagaauggcgguuuuaggggauacugcaugggauuuuggaagugugggaggagcauuaaacagccuggguaaagguauacaucaaauauucggagcagcauucaaaucauuauuuggaggaaugagcugguuuagucagauacuaauuggaacauuacugauguggcuuggauuaaacaccaaaaacggaucaauuagcuuaaugugcuuagcacuugguggaguauuaauauuccuaaguacaguaguuucagcagauguagguugcucaguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7001 - RNA, 2524 nt, Artificial Sequence
  KX811222.1 prME-long mRNA Design 2 opt
ggggcgcugccuacggagguggcagccaucuccuucucggcaucaagcuuaccaugagaauuauaaaugccagaaaagaaaaaaaaagaagaggcgccgauacaucaguagggauaguaggauugcuauuaacaacagccauggcagcagaaguuacaagacgaggaucagcauauuacauguacuuagauagaaaugaugcaggagaagcuauaaguuucccgacuacuuuaggaaugaacaaguguuauauucaaauuauggacuuaggacacaugugugacgcaacaaugucauaugaaugcccaauguuagacgaaggaguagaaccagaugauguagauuguugguguaacacuacaagcgcuugggucgucuacgggacaugccaccacaaaaaaggagaagcuagacgaaguagaagagcaguaacccuaccaucucauaguacacgaaaacuacaaacuagaccucaaaccugguuagaaucaagagaauacacaaaacauuuaauacgaguagaaaauuggauauucagaaacccaggauucgcguuggcagcggcggcaauugcaugguuauuaggaucaaguacaucucaaaaagucauauauuugguuaugauacuuuuaauagcuccagcauauagcauacgauguauaggaguaagcaauagagacuuuguggaaggaaugucaggagggacauggguugacguagucuuagaacauggaggauguguaacggucauggcacaagauaaaccaacaguugauauagaauuaguaacaacaacaguaucaaauauggcagaaguuagaucauauuguuaugaagcaucaaucucagacauggcaagugacucaagaugucccacgcaaggugaagcauaucuagacaaacaaagugauacacaauauguaugcaaaagaacacuuguagacagaggauggggcaacggaugcggucucuuugguaagggcagcuuaguuacaugugcaaaauucgcguguaguaaaaaaaugacagguaaaucaauacagccugaaaaucuugaauaucgaauuauguuaucuguucacggaucacaacauucuggcaugauuguaaaugacacaggucacgaaacagaugaaaacagagcuaaaguagaaauaacaccgaacucaccaagagcagaagcuacuuuaggagguuuugggaguuuaggacuagauugcgaaccaagaacaggacuugauuuuagugauuuauacuauuuaaccaugaauaauaaacauuggcugguacauaaagaaugguuucaugauauuccauuaccauggcaugcaggagcugauacaggaacaccccacuggaauaauaaagaagcgcuuguagaauuuaaagacgcacaugccaaaagacaaacaguaguaguuuuagguagucaagaaggggcaguccauacagcacuagcgggagcauuagaagcagaaauggauggagcaaaaggacgauuaagcucaggacaucuaaaauguagacugaaaauggauaaauuaaggcuaaaaggaguaagcuauagucuuugcacagcagcauucacuuuuacaaaaauuccagcggaaacacuacauggaacuguaacaguagaagugcaauacgcaggaacugauggaccguguaaaguuccagcacaaauggcaguagauaugcaaacauuaacaccaguaggacguuuaauaacagccaauccaguaauaacagaaucaaccgaaaacucgaaaaugaugcuagaauuagauccuccuuuuggagauucguacauaguuauaggugucggagaaaaaaagaucacacaucacuggcauagaagcggcaguacaauaggaaaagcauuugaagcuaccguacguggagcuaaaagaauggcaguucuaggcgauacugcaugggauuuuggcucaguuggaggugcauuaaacagcuuagggaaaggaauacaucaaauuuuuggugcagcauucaaaagcuuguuuggaggaaugucaugguuuagccaaauauuaauuggaacuuuacuuaugugguuaggacuaaauacaaaaaaugguaguauaucauuaaugugucuugcauuagguggaguauugauuuuuuuaucaacagcaguaagcgcagauguaggauguucaguagacuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7002 - RNA, 2524 nt, Artificial Sequence
  KX447516.1 prME-long mRNA Design 2 opt
ggggcgcugccuacggagguggcagccaucuccuucucggcaucaagcuuaccaugagaauaauaaaugcacgaaaagagaaaaagagacgaggcgcagacacaaguguaggaauaguaggccuacuuuuaacuacagcaauggcugcagaaguaacgagacgagguuccgcauauuauauguaccuugacaggaaugacgcaggggaagcaauauccuuuccaaccacauuaggaaugaauaaauguuacauacaaauaauggaucuaggacauaugugugaugcaacaaugaguuaugaauguccaaugcuggaugaaggaguagaacccgaugacguagauuguuggugcaauacuacaucaacauggguaguauaugggaccugucaucauaaaaaaggagaagcaagaaggaguagaagagcagucacauugccgagucacucaacaagaaaauuacaaacaagaucccaaacauggcuugaaucuagagaauacacaaaacaucuuauaagaguugaaaauuggauuuucagaaaccccggauucgcgcuagcagcagcagcaauagcauggcuccuuggaucauccacaaguaaaaaaguaauauacuuagugaugauauuacuaaucgcaccagcauacaguauacguugcauaggaguaucaaaucgagauuucguugaagggaugucuggagguacauggguagauguuguacuagaacaugguggauguguuacaguaauggcgcaagacaaaccuacagucgauauagaacuaguaacaacuacaguaagcaauauggcagaaguccgaucauacuguuacgaagcaaguauaucugacauggcaagcgacagucgauguccaacacaaggagaagcauaucuagauaaacaaucugacacacaauauguuugcaaaagaaccuuaguugauagaggaugggguaauggguguggcuuauuuggcaaggguagucuuguaaccugugcaaaauucgcauguaguaaaaaaaugacaggaaaaagcauacaaccagaaaaucuagaauauagaauaauguuaucaguacaugguagucaacauucaggaaugauaguuaaugacaccggacacgaaacugaugaaaaucgagcaaaaguagaaauaacaccaaauaguccacgagcagaagcuacauuaggcggauuuggaucguuaggauuagauugugaaccaagaacuggauuagauuuuagugaucuauauuaccuaacaaugaauaauaaacacugguuaguacauaaagaaugguuucacgacauaccacuacccuggcacgcuggagccgauacuggaacaccacauuggaacaacaaagaagcacuaguagaguuuaaagaugcacacgcaaaaagacaaacaguaguaguauuaggaucacaagaaggcgcaguccauacagcacuagcaggagcauuagaagcggagauggacggagcaaaaggaagacuaaguucaggccauuuaaaaugcaggcuaaaaauggauaaauuaagauuaaaaggaguaucauauucacuauguaccgccgcauuuacauuuacaaaaauaccagcagaaacuuuacauggcaccguuacugucgaaguccaauaugcuggaacagauggaccauguaagguuccagcucaaauggcaguggauaugcaaacacuaacuccaguagguagacuaauaacagcaaauccgguaauuacugaaucaacagaaaacucaaaaaugaugcuagaauuagauccuccguucggagacucguacauaguuauagguguaggugaaaaaaaaauaacacaucauuggcauagaucaggaucaaccauagggaaagcuuuugaggcuacgguaagaggagcaaaacgaauggccguuuuaggagauacugcaugggauuuuggaagcguaggaggagcauuaaacucauuaggaaaaggaauacaucaaauauuuggagcagcauuuaaaagucuauuuggaggaaugucaugguuuucacaaauacuaauaggaacucuguuaaugugguuaggacuaaauacaaaaaauggaucuauaagccuuaugugccuagcucuaggaggaguuuuaauauucuuaaguacagcuguaucagcagauguuggauguucuguagacuucucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7003 - RNA, 2524 nt, Artificial Sequence
  KX520666.1 prME-long mRNA Design 2 opt
ggggcgcugccuacggagguggcagccaucuccuucucggcaucaagcuuaccaugagaauuauaaaugcacgaaaagaaaagaaaagaagaggcgcugauacaagcgugggaauugugggauuauuauuaacaacagcaauggcagcggaaguuacaagaagaggaagugccuauuauauguaucuagauagaaaugacgcaggagaggcaaucucauuuccaacuacacuuggaaugaauaaauguuacauccaaauaauggacuuaggacauaugugcgaugcaacuaugucauacgaauguccgauguuagaugaaggaguagagccagacgauguagauugcugguguaauacaacuucaacauggguaguauacggcacgugucaucauaagaaaggcgaagcuagacgauccaggagagcaguaacauuaccuucacauaguacaagaaaauuacagacaagaucacaaacaugguuagaaucuagagaauauacaaaacaucuaauuagaguugaaaacuggauauuuagaaacccaggauucgcacuagcagcugcagcaauagcaugguuacuaggcagcucuacgagacaaaaaguaauauaccuuguuaugauacuccuaauagcaccagccuauucaauuagaugcauaggaguaaguaacagagauuuuguugaaggaaugagcggagguacauggguagauguaguauuagaacauggaggaugugugacaguaauggcacaggauaaaccaacuguagacauagaauuaguaacaacaacuguaagcaauauggcagaaguaagaaguuacuguuaugaagccucaaucagcgauauggcaagugauucaagauguccaacacaaggugaggcuuauuuagauaaacaaagcgacacacaauauguaugcaaaaggacauuaguagacagaggauggggaaacgguugcggccuauucggaaaaggaagucuaguuacaugugcaaaauuugcuuguucuaagaaaaugacaggaaaaagcauacagcccgaaaaccuagaauaucgcauaauguuaagcguacauggaucacaacauaguggaaugauaguuaaugauacaggacacgaaacagaugaaaacagagcaaaaguggaaauaacuccaaauucacccagagcagaagcaacacuaggaggauucggaucacuaggacuagauugugaaccgaggaccggauuggauuuuagugauuuguacuauuugacuaugaauaacaaacauuggcuaguacacaaagaaugguuucaugauauaccauuaccauggcaugcaggagcagauacggguacaccacauuggaauaacaaagaagcauuaguagaauuuaaagacgcacaugcaaaacgacaaacaguaguaguacuugggagucaggaaggagcaguacauacagcauuagcaggagcauuagaagcagaaauggauggugcaaaagguagacuuucauccggacaccugaaaugucgacuaaaaauggauaaauuaagauuaaaaggggugagcuacagcuuguguacugcagcauuuacuuuuacuaaaauaccagcugaaacacuucauggaacaguaacuguagaagugcaguaugcaggaacagaugguccauguaaaguaccagcacagauggcuguagauaugcaaacucuaacaccuguuggcaggcuaauaacugcaaauccaguaauaacagaaucaacagaaaacucaaaaaugauguuggaauuagauccaccauuuggagauaguuacauaguaauagguguuggggaaaagaaaauuacucaucauuggcacagaucaggaucuacgauaggaaaagcauuugaagcuacuguaagaggcgcaaaaaggauggcaguauuaggugauacggcaugggacuuuggaucuguagguggagcguugaauagucuagguaaaggaauacaucaaauauuuggagcagcauuuaaaucauuauuugguggcaugaguugguuuagucagauacuuauaggaacucuauuaaugugguuaggauuaaacaccaaaaauggaucaauaucacuuauguguuuagcauuagggggaguccuaaucuuccuaucaacagcaguaagcgcggauguaggauguucaguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7004 - RNA, 2524 nt, Artificial Sequence
  KU729218.1 prME-long mRNA Design 2 opt
ggggcgcugccuacggagguggcagccaucuccuucucggcaucaagcuuaccaugcguauuauaaaugcaagaaaagaaaagaaaagaagaucagcagauacaucaguugguauugugggcuuacuucucacaacagcgauggcagccgaaguaacuagaagaggaucagcuuacuacauguauuuagacaggaaugacgcuggggaagcuauaucauuuccuacaacauuaggaaugaauaaaugcuauauacaaauaauggaccuuggacacaugugugaugcaaccaugagcuaugaauguccaauguuagacgaaggaguagagccagaugauguagacuguuggugcaauacuacuuccaccugggugguauauggaacaugccaccauaagaaaggugaagcaagaagaaguagacgagcaguaacacugccaucacacaguacaagaaaacuucaaacaagaagccaaacauggcuagaaaguagagaauauacaaaacauuuaauaagaguagaaaacuggauauuuagaaauccuggauuugcuuuagcugcugcagcaauagcauggcuauugggaagcaguacaagccaaaaagucauauaccuaguaaugauacuucuuauagcaccagcauauucaauaagauguauaggaguaucaaauagagauuuugucgaaggcaugaguggaggaacauggguagauguuguuuuagaacauggaggauguguaacaguaauggcacaagauaaaccaacaguagacauagaauuaguaacaacaacagucucaaacauggcagaaguaagaucauauuguuacgaagcaucaauuucagauauggcuucagauucaagauguccuacacaaggagaagccuaccuagauaaacaaagugacacucaauacguaugcaaaagaacucuaguagauagagguuggggaaacggauguggguuauuuggaaaaggaagccucguaacaugugcaaaauucgccugcaguaagaaaaugacaggaaaaagcauacaaccagaaaacuuagaauauagaauaaugcuuaguguacacgguucucaacauucaggaaugauaguaaacgauacaggccaugaaacagaugaaaacagagcgaaaguagaaauaacaccaaauucacccagagcagaagccacacuuggaggauuuggcucauuaggauuagauugugaaccacgaacaggacuagacuuuagugaucuauauuacuuaaccaugaauaacaaacacuggcuaguacauaaagagugguuucacgauauuccacucccauggcacgcaggagcagauacuggaacaccgcauuggaauaauaaagaagcccucguagaauuuaaagaugcacaugcuaaaaggcaaacggugguaguauuaggaagucaagaaggagccguacacacagcauuggcaggggcacuagaggcugaaauggacggagcaaaaggucgauuaucaaguggacauuuaaaauguagauuaaaaauggauaaauuaaggcuaaaaggaguaucguauucauuaugcacagcagcauuuacauuuacaaaaauuccggcggaaacacuacauggaacaguaacaguagaaguacaauaugcgggaacagacgguccauguaaaguaccugcacaaauggcaguagauacacaaacuuugacaccaguaggaagacuaauuacagcaaauccaguaauaacugaaucaacagaaaauucaaaaaugauguuagaauuagauccaccuuucggagauaguuacauaguaauuggagugggggaaaagaaaauaacccaccacuggcaccgaagcgguucaacuauaggaaaagcauuugaggcaacaguuagaggcgcaaaaagaauggcgguauuaggagacacagcaugggauuucggaucuguaggaggggccuuaaacucacuaggaaaaggaauacaucaaauauuuggagcagcguuuaaaucacuauuuggugggaugucuugguuuagccaaauacuuauaggcacgcuacuaauguggcucgguuuaaauaccaaaaauggaucuauaaguuuaaugugucuagcauuaggaggaguacuaauauuuuugaguacagcagugucagcugauguaggcuguucaguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7005 - RNA, 2524 nt, Artificial Sequence
  KU761561.1 prME-long mRNA Design 2 opt
ggggcgcugccuacggagguggcagccaucuccuucucggcaucaagcuuaccaugagaauuauaaaugcaagaaaagaaaaaaaaagacgaggagcagacacuaauguagguaucguaggacuauuauuaacgacagccauggcagcugaaguaacccgaaggggaucggccuauuacauguauuuagauagaaaugaugcaggagaagcaauaaguuuuccaacaacguuagguaugaauaaauguuacauacaaauaauggauuuaggucauaugugugacgcaacaaugaguuacgaaugcccaauguuagaugaagguguggaacccgaugacguugauugcuggugcaauacaaccucaacauggguugucuaugggacaugucaucauaaaaaaggagaagcaagaagaaguagaagggccguuacucuuccaagccauagcacaagaaaacuccaaacuagaucacaaacauggcuagaaaguagagaauacaccaaacacuuaauaagaguagaaaauuggauauuuagaaauccaggauuugcauuagcagcagcagcuauagcauggcuauuaggaucgucuacaagucaaaaaguaauauauuuaguuaugauacuacuaauagcaccagcauacagcauaaggugcauaggcguaucaaacagagauuuuguugaaggaaugucaggaggaaccuggguagauguaguguuagaacauggagggugcgugacaguaauggcccaagauaaaccaacaguugauauagaacuugucacgacaacagugucaaacauggccgaaguaagauccuauuguuacgaagcaucaauaucggauauggcauccgauagcagauguccuacacaaggagaagcauauuuagacaaacaaagcgauacacaauauguauguaaacgaacauuaguugacagagggugggguaauggguguggacuauucgguaaagguaguuuagucacuugcgcaaaauuugcauguucuaagaaaaugacaggaaaaucaauacaaccggaaaaccuagaauacagaauaaugcuaucagugcauggaucacaacauagcggaaugauaguaaaugacacuggucacgagacagaugaaaauagagcaaaaguagaaauaacaccaaauucaccaagagcggaagcaacauuaggagguuuuggaucauugggauuagauugcgaaccaagaacaggauuagauuuuucagaucuuuauuaucugacaaugaauaauaaacauuggcuagugcacaaagaaugguuccaugauauaccccuaccauggcaugcaggugccgauaccggaacaccacauuggaauaauaaagaagcauuaguugaauuuaaagaugcucacgccaaaagacaaacaguaguaguauuaggcucacaagaaggggcaguacauaccgcauuggcuggagcguuagaagccgaaauggacggugccaaaggaagacucucaaguggucauuugaaaugcagacuaaaaauggauaaauuaagauuaaaaggaguaucauauaguuuaugcacagcugcauuuacauuuacaaaaauaccagcagaaacucuacauggaacaguuacaguugagguucaauaugcaggaacagauggaccaugcaaagucccugcacaaauggcaguagacaugcaaacacugacaccuguaggaagauuaauaacugcaaauccgguaauaacagaaaguaccgaaaacucgaaaaugauguuagaacuugauccuccguucggagacagcuacauuguaauaggaguaggagaaaaaaaaauaacgcaucacuggcauagaucaggaucgaccaucggaaaagcauuugaggccacugugaggggagcaagaagaauggcaguauuaggcgauacagcuugggauuuugguucagucggaggagcauugaauaguuugggaaaaggaauacaucaaauauuuggagcagcauuuaaaucauuauuuggugguaugagcugguucucccagauauuaauaggaacacuauuaaugugguuagguuuaaauacuaaaaauggaaguauaucauuaauguguuuagcuuuaggaggcguacuaauauuuuuaucaacggcuguuucagcagaugugggaugcucaguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7006 - RNA, 2524 nt, Artificial Sequence
  KY317938.1 prME-long mRNA Design 2 opt
ggggcgcugccuacggagguggcagccaucuccuucucggcaucaagcuuaccaugaggauaauuaaugcuagaaaagaaaagaaaagaagaggagcagaaacaaguguaggaaucguugguuuauuauuaacaacugcuauggcagccgaaguaacaaggagagggagugccuauuacauguauuuagacagaaaugacgcaggagaagcaauuuccuucccaacuacuuuagguaugaacaaauguuauauacaaauaauggauuugggacauaugugcgaugcgacaaugaguuaugaauguccaaugcuagacgaaggagucgaaccugaugacguagacuguugguguaacaccacaaguacauggguaguauauggaacgugccaucauaagaaaggagaagcgagaagaaguaggagagccguaacauuaccaagucacagcacaagaaaauuacaaacaagaagucaaacaugguuagaaucaagagaauauacaaaacaccuaauaaggguagaaaacuggauauuuagaaauccaggauuugcauuggcagcagcagccauagcaugguuguuaggaucaaguacaagucaaaaaguaauauauuuaguaaugauauuauuaauagcaccagcauauucaauaagaugcauagguguaucaaauagagacuuuguagaagguaugaguggaggaacuuggguagauguaguuuuagaacacggaggaugcguaacaguaauggcucaagacaaaccaacaguagauauagaauuagucacuacaacaguaucaaauauggcagaagucagaagcuauuguuacgaagcaagcauuucagacauggcaucugauucacguuguccuacgcaaggagaagccuauuuagauaaacaauccgacacacaauauguauguaaaagaacccuaguagacagagguugggguaauggauguggccuauucgggaaaggaaguuuagucacaugugcuaaauuugcaugcaguaagaaaaugacaggaaaaucaauacaaccggaaaaucuagaauacagaauaaugcuaaguguacauggaagucaacauuccggcaugauagugaaugauacugggcaugaaaccgaugaaaacagagcaaaaguagaaauaacaccaaauucuccgcgugcugaagcuacacuagggggauuuggaucauuaggucuugacugugaaccaaggacugguuuagauuucucggaucuauauuaucuaacuaugaauaacaaacauuggcuuguacauaaagaaugguuucacgauauaccacuaccauggcaugcaggagcagauacagggacuccucacuggaacaauaaagaagcauuaguugaguuuaaagaugcacaugcaaaaagacaaacuguaguuguauuaggcucacaagaaggugcaguacacacagcucuagcaggggcucuagaggcggaaauggauggugcaaaaggaagacuuucaaguggacacuuaaaaugcagacuaaaaauggauaaauugagauuaaaaggaguaaguuauucuuuauguacagcagcauucacauuuacaaaaauaccagcagaaacauuacauggaacaguaacaguugaaguacaauacgcgggaacagaugggccaugcaaagucccagcgcaaauggcuguagacaugcaaacgcugacacccguagggcgacuaauuacugcaaauccaguaauaacugaaaguacagaaaacaguaaaaugaugcuggaauuagaucccccguuuggagacagcuauauaguaauaggaguaggugaaaagaaaaucacacaucauuggcauagaucagguucaacaauaggaaaagccuuugaagcaacaguuagaggagccaaacggauggcagugcuuggagauacggcuugggacuucggaucaguaggaggcgcauuaaacaguuuagggaaaggaauacaccaaauuuucggugcagcuuuuaaaaguuuauuuggaggaaugucaugguuuucucaaauauuaauaggaacuuugcuaauguggcuaggauuaaacaccaaaaauggaucaauaucacugaugugucuagcucuaggugguguauuaauauuucuaucaacagcaguuucagcagauguuggaugcucaguugauuuuucgaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7007 - RNA, 2524 nt, Artificial Sequence
  KY075939.1 prME-long mRNA Design 2 opt
ggggcgcugccuacggagguggcagccaucuccuucucggcaucaagcuuaccaugagaauaauaaaugccagaaaagaaaagaaaagaagaggugcagauacauccguaggaauaguaggauuacuuuuaacaacagcaauggcagcagaaguaacaagaagggguucagcauauuauauguaccuagauaggaaugacgcgggagaagcuauaucauuucccacaacccuaggaaugaauaaaugcuauauacagaucauggaccuuggacauaugugugaugcaacaaugucauacgaauguccaauguuagaugaaggaguagaaccggaugacgucgauugcuggugcaacacuacgaguaccuggguagucuauggaacaugucaucauaaaaagggagaagcaagacgaaguaggagagcagucacuuugccaagucacaguacuagaaaacugcagacaagaagucaaacaugguuagaaucaagagaauauacuaagcaccuaauaagaguugagaauuggauauuuagaaacccagguuuugcucuugcagcugcggcuauagcguggcuguuaggaucaucaacaagucaaaaaguuauauacuuagugaugauauuauuaauugcuccugcauauucacuaagauguauuggaguaaguaauagagauuuuguagaagguaugaguggaggcacguggguugauguaguacuagaacauggcggauguguuacaguaauggcacaagauaaaccuacaguagauauagaauuaguaacuacuacaguaaguaauauggcagaaguuagaaguuacuguuaugaagcaaguauaucagauauggcaagugauucaagaugucccacgcaaggagaggcuuaucuagauaaacaaucagauacacaauacgucuguaaacgaaccuuaguagaucgagguuggggaaaugggugcgguuuauucggaaaaggaucauuaguaacuugugcaaaauuugcauguucaaagaaaaugacaggaaaaagcauccaaccagaaaacuuagaauauagaauaauguuaaguguacaugguucucaacauucaggaaugauaguaaacgacacaggccaugaaacagaugaaaauagagcaaaaguagaaauaacaccaaauucaccaagagcugaagcgacuuuaggaggauuugguagcuuagguuuagauugugaacccagaacaggauuggauuucagugauuuauauuaucuaacgaugaauaacaaacauugguuaguacauaaagaaugguuccaugauauaccauugccuuggcaugcuggagcagauacaggaacgccacacuggaauaauaaagaagcauuaguagaauuuaaagaugcacacgcgaaaagacagacaguagucguacuaggaucacaagaaggagcaguacauacagcauuggccggagcuuuagaagccgaaauggauggagcaaaaggcagauuaagcaguggccacuuaaaaugucgauuaaaaauggauaaauuaagauuaaaaggagucaguuacagcuuauguacagcugcauucacauuuaccaaaaucccagcagaaacauuacaugguacugugacaguagaaguacaauacgcuggaacagauggcccuuguaaaguaccagcacaaauggcaguagauaugcaaacauuaacaccgguaggaagguuaauuacugcaaauccaguaauaacugaaucaacagaaaauaguaaaaugaugcuagaauuagacccacccuuuggggauaguuauauagugauaggaguaggagaaaagaaaauaacacaccacuggcaucguagcggaaguacaauaggaaaagcauuugaagcuacgguaagaggggcaaaacgaauggcugugcuaggggacacagccugggauuucggaucagugggaggugcauuaaauucauuaggaaaagggauacaucaaauauucggagcugcguuuaaaucauuauucggaggaaugaguugguuuucucaaauauuaauuggaacgcuucuaauguggcuaggacuaaauacuaaaaacgguucaauaucucugauguguuuagcauugggaggaguacuaauauuccuuaguacagcaguaagugcggauguaggcugcucaguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7008 - RNA, 2524 nt, Artificial Sequence
  KX806557.2 prME-long mRNA Design 2 opt
ggggcgcugccuacggagguggcagccaucuccuucucggcaucaagcuuaccaugagaauuauaaacgcaagaaaagaaaaaaagagaagaggagcugacacuaauguaggaauaguaggacuguuauuaacaacagcgauggcagcagaaguaacgagaagaggaucugcauacuauauguauuuagauaggaaugaugcaggagaagccauaucauuuccgacaacauugggaaugaauaaauguuacauacaaauaauggaucuaggacauaugugugacgcaacaaugaguuacgagugucccauguuagaugaagggguugagccagacgauguggauuguugguguaacacaacaaguacuuggguuguauauggaacuugccaccauaaaaaaggugaagcuagaagaucacguagggcgguaacacuaccaucucacaguacccguaaacuacaaacgagaagccagacaugguuagaaagcagagaauauacaaaacauuuaauaagagucgaaaauuggauguuuagaaauccaggcuuugcauuagcagcagccgcuauagcauggcuucuuggaucaaguacaucacaaaaaguuauauauuuaguaaugauauuguuaauagccccagcuuacucaauaagauguauuggaguaagcaacagagauuuuguagaaggaaugaguggaggaacauggguugauguaguacuagagcauggugggugcguaacagucauggcgcaagacaaaccuacaguagauauagaauuaguaacaacaacaguaaguaauauggcagaagugcgaucauauuguuacgaagcaagcauuucugauauggcaucagauagucguuguccaacacaaggagaagcauaccuagauaaacaaucagauacccaauacguauguaaaagaacuuuaguagaucgagguugggguaauggauguggacuauuugguaaaggaagccuaguuacuugugcuaaguuugcaugcaguaaaaaaaugacagguaaaucaauacaaccagaaaaucuagaguauagaauaauguuaaguguacauggaagucaacauagugguaugauuguaaaugauacaggacacgaaacagacgaaaaccgagcuaaaguagaaaucacgccaaauagucccagggcagaagcaacauuaggaggauuuggcucguuaggauuagacugugaaccacgaacugggcuagauuuuagcgauuuauauuaucuaacaaugaacaacaaacacugguuaguacauaaagaaugguuucaugauaucccacuaccuuggcaugccggagcagacacaggaacaccacacuggaauaauaaagaagcacuaguagaguuuaaagacgcacaugcgaaaaggcaaacaguaguaguacuaggaucacaagaaggagcgguacauacggcacuagcuggagcccuagaagcagagauggacggcgcuaaaggaagauugagcaguggacaccuaaaaugucguuugaaaauggauaaauuaagacucaaaggaguaaguuauucguuaugcacagcugcguuuacauuuaccaaaauaccagcagaaacgcuacauggaaccguaacgguggaaguucaauaugcaggaacagauggaccaugcaaaguaccagcucagauggcgguagacaugcaaacauuaacaccaguagggagguuaauaacagcaaacccugugauaacugaaaguacagaaaauaguaagaugaugcuagaacuagauccaccauucggagauucauauauaguaauaggaguaggggaaaaaaaaauaacucaucauuggcauagaagugguaguacaaucggaaaagcauuugaagcaacaguacgcggggcaaaaagaauggcaguacuuggagauacagcaugggauuuuggaaguguaggaggugcguuaaauaguuuaggaaaaggaauacaucaaauauucggggcagcauucaaaaguuuauuuggaggaaugaguugguucagucaaauauuaauaggaacauuguuaauguggcuaggucuuaauacaaaaaaugguucaauaaguuuaaugugucuugcauuaggaggagucuuaauauuuuuaagcacagcaguaagugcggacguuggguguucaguugacuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7009 - RNA, 2524 nt, Artificial Sequence
  KU870645.1 prME-long mRNA Design 2 opt
ggggcgcugccuacggagguggcagccaucuccuucucggcaucaagcuuaccaugagaauaauaaaugcacgcaaagagaaaaaaagaagaggagcagauacaaguguaggaauaguugguuuauuacuaacaacagcaauggcagcugaagucacaagaagaggaucagcauauuauauguaccuagacagaaacgaugcuggagaagcgauaucauuuccuacgacacuugguaugaauaaaugcuauauucaaauaauggacuugggacauaugugugaugcaaccaugucauacgaaugcccuauguuagaugaggguguagaaccugacgauguagauugcugguguaacacaacuaguacuuggguaguuuauggaacaugucaccacaaaaagggagaagcaagaagaucaagaagggccguaacucucccaucacacaguacaagaaaauuacaaacaagaucacaaacgugguuagaaucaagagaauauacaaaacacuuaauaagaguugaaaauuggauacuacguaauccaggauucgcacucgcagcugcggcuauagcauggcucuuagguucgaguaccucucagaagguaauauacuuaguaaugauauuauuaauagcaccagcuuauucuauaagauguauaggagucaguaauagagauuuuguugaaggaaugucaggaggaacuuggguagacgugguacuggaacacggaggaugcgugaccguuauggcgcaagauaaaccaacgguagauauagaauuaguaacaaccacaguuaguaauauggccgagguaaggucuuauuguuaugaagccucuauaucugacauggcaucagacucaagaugcccuacacaaggagaagcauauuuagauaaacaaucagauacacaauauguauguaaacgaacacuaguagauaggggcugggguaauggaugcggacuauucggaaaaggaaguuuagucacaugugcaaaauucgcauguucuaaaaaaaugacaggaaaaucaauacaaccagaaaauuuagaauaucgaauuauguuaucaguacauggaucacaacauucuggaaugauaguaaacgacacaggccacgaaacagacgaaaauagagcaaaaguugaaauaacaccaaauaguccucgagccgaagcaacacuuggagguuuuggaagucuaggauuagauugugaaccaagaacaggauuagacuucucggaucuauauuaucugaccaugaauaauaaacauugguuagugcacaaagaaugguuucaugauauaccguuaccauggcaugccggagcagauacaggcacaccacauuggaauaauaaagaagcacuaguagaauucaaagaugcucacgcuaaaagacaaacagugguaguauuagguagccaagaaggagcaguacacacagcccuagcaggugcucuugaagcagaaauggauggagcaaagggaagauuaaguuccggacaccugaaaugcagacuaaaaauggauaaauuaagacuaaaaggagucucauauucauugugcacagcagcauuuacuuuuacaaaaauuccagcagaaacguugcacggaacaguaacuguagaaguacaauacgcaggaacagauggaccguguaaaguaccagcacaaauggcaguugauaugcaaaccuuaacaccaguuggaagauuaauaacugcaaacccaguaauaacagaaaguacggaaaauucaaaaaugauguuagaauuagauccuccauucggagauucauacaucguaauaggaauaggagaaaaaaaaauaacacaucauuggcacagaucgggaucaacaauagguaaagcauuugaagcuacaguaagaggagcaaaacggauggcaguauuaggagacacugccugggauuuuggaucaguagggggagcauuaaauucacuaggaaaaggcauccaucaaauauuuggugcugcuuuuaaaucccuauucggaggaaugagcugguucucacaaauacuuauuggaacucugcuaauguggcuaggauuaaauacaaaaaauggaagcauaagcuuaaugugucuagcucuaggaggcguucuaauuuuuuuaaguacagccguaucagcugacguaggauguucagucgauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7010 - RNA, 2524 nt, Artificial Sequence
  KU729217.2 prME-long mRNA Design 2 opt
ggggcgcugccuacggagguggcagccaucuccuucucggcaucaagcuuaccaugagaauaauuaacgcuagaaaagaaaagaaaagaagaggagcugacacaagcgugggaauaguaggacucuugcuaacaacagcaauggcugcagaaguaacaagaagaggaagugcauauuauauguauuuggaucgaaaugacgcaggagaagcaauaucauuuccaacaacacucggaaugaauaaaugcuauauacaaauaauggaucucggacauaugugcgacgccacaaugucuuaugaauguccuaugcuagaugaaggaguagaaccagacgaugucgauuguugguguaauacaacaagcacaugggugguauacggaacaugucaucauaagaaaggugaagcaaggagaaguagacgggcaguaacacuaccaucacauaguacgcgaaaacuacaaacaagaucacaaacuuggcuagaaucaagagaauacacaaaacaucuaauuagaguagaaaacuggauauuuagaaacccaggcuucgcacuggcagcagcagcaauagcaugguugcuagggucaagcacaucacaaaaaguuauauauuuaguaaugauauuauugauagcuccagcauacaguauaagauguauaggagugucaaaucgagauuuuguugaaggaaugucaggaggcacuuggguagauguaguauuagaacauggugguugcguaacaguaauggcucaagauaaaccaacaguagauaucgaauuaguaucaacaacaguuucaaacauggcagaaguaagaucuuauuguuacgaagcaaccauaagcgauauagcaagugauucaagguguccuacacaaggagaagcauaucuagacaaacaaucagauacacaauacguaugcaaaagaacauuaguugauagaggauggggaaauggaugcggguuauuuggaaaagggaguuuaguaacuugugcaaaauuugcguguucaaagaaaaugacaggaaaaucaauacaaccagaaaacuuagaauaucgaauuauguugucaguacauggaucacaacauagcgggaugauagucaaugauacaggacaugaaacugacgaaaauagagcaaaaguagaaauaacaccaaauagcccuagagccgaagcuacauuaggaggauuugguucacucggacuagacugugaaccaaggacuggucuugauuuuucagauuuauauuacuuaacaaugaauaauaaacacugguuaguccacaaagaaugguuucaugacauaccauugccuuggcaugcaggagcagauaccggaacaccacacuggaauaauaaagaagcauugguagaauuuaaagacgcucaugcaaaaaggcaaacagcuguuguacucggaucucaagaaggagcaguucacacagcuuuagcuggagcacuugaagcagaaauggauggagcaaaaggaagacuaucuucgggccauuuaaaaugcagacuaaaaauggauaaauugcgauuaaaagggguuaguuacaguuuauguacagcggcuuuuacuuuuacaaaaauaccagcagaaacacuacauggaacaguaacaguagaaguacaauaugcggguacagauggcccaugcaaaguaccagcacaaauggcaguagauaugcaaacacuaacgccaguaggaaggcugauuacagcaaauccaguaauaacagaaucuacugaaaacucaaaaaugaugcucgaacuagauccaccauuuggggauucuuauaucguuauaggcguaggcgaaaagaaaauuacacaccauuggcacagaucaggaucaacaauaggaaaagccuuugaagcuacaguaagaggugcaaaaagaauggcuguucuuggagacacagcaugggauuuugguaguguagggggagcauugaacucacuagggaaaggcauacaucaaauuuuuggugcagcauuuaaaucauuauucggaggaaugagcugguuuagccaaauucuaauuggaacuuuacugauguggcuaggccuuaauacuaaaaauggaaguauaucacuuaugugcuuagcauuaggaggaguacugauauuuuuaucaacagccguuucagcagacguugguugcaguguugauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7011 - RNA, 2524 nt, Artificial Sequence
  KU497555.1 prME-long mRNA Design 2 opt
ggggcgcugccuacggagguggcagccaucuccuucucggcaucaagcuuaccaugagaauaauaaacgcucguaaagaaaaaaagagaagaggagcagacacaaguguaggcauaguaggauugcuuuugacuacagcaauggcagcagagguaacaaggagagggucagcuuauuauauguacuuagacagaaacgacgcaggugaagccauauccuuuccgacaacacuagguaugaauaaaugcuacauacaaaucauggauuuaggacauaugugcgaugcaacaaugagcuacgaauguccaauguuagaugaaggaguagaaccagaugauguugauuguugguguaacacaacuagcacauggguagucuauggcacaugucaccacaaaaaaggcgaagcuagaagauccagacgagccguaacauuaccuagucauagcacgagaaagcuacaaacaagaagccaaacaugguuagaaaguagagaauauacaaaacaucuaaucagaguggaaaacuggauauucagaaaccccgguuuugcauuagcugcagcagccauagcauggcuauuaggaaguucaacgagccaaaaaguaauauauuuaguaaugauauuacugaucgcuccagcauauucaauacgauguauagggguaagcaauagagacuucgucgaaggaaugucaggaggaacauggguagauguugugcucgaacacggugguugugucacaguaauggcacaagauaaaccaaccgucgauauagaacuaguaacaacaacaguuucaaauauggcagaaguaagaucuuacuguuaugaggcaaguauaagugauauggcgucagauucaagaugcccaacucaaggagaagcauauuuagauaaacaaagugauacacaauacguauguaaaagaacuuuaguagauagaggauggggaaauggcuguggucuauuuggcaaaggaagucuaguaacuugugcaaaauucgcaugcagcaaaaaaaugacaggaaaaagcauacaacccgaaaacuuagaauaucgaauaaugcugucaguccauggaagucaacacagugguaugauaguuaaugauacuggacaugaaacagacgaaaauagagcgaaaguagagauaacuccaaauucgcccagagcagaagcuacccuaggagguuuuggaucacucgguuuggauugcgaaccucgaacagguuuagacuuuagcgacuuauauuaccuaacaaugaacaauaaacauuggcuaguacacaaagaaugguuucaugauauaccuuuaccauggcaugcuggcgcagauacaggaacaccgcauuggaauaauaaagaagcacuaguagaauuuaaagaugcacaugccaaaagacaaacugucguuguauuagguacacaagaaggagcuguacauacagcauuagccggagcauuagaagcagagauggacggugcaaaaggccgauuaaguucagggcaucuaaaauguagauugaaaauggacaaauuacgacuaaaaggaguuucauauucauuauguaccgcagcauucacuuuuacaaaaauaccugcagagacauuacaugguacaguaacaguagaaguacaauaugcaggaacagacggaccauguaaaguaccugcucaaauggcaguagauaugcagacucuaacaccagucggcagauuaauaacagcaaaucccguaauaacagaaucgacggaaaauucuaaaaugauguuagaacucgauccuccauuuggagauaguuacauaguaauugggguaggagaaaaaaaaaucacucaucauuggcauagaaguggaucgacgauaggaaaagcauucgaagcaacaguacgaggagcuaaaagaauggcuguuuuaggugacacugcaugggacuuuggaucaguuggaggagcguuaaauagcuuaggaaagggaauacaucagauauuuggagcagcguucaaaagucucuucgguggaaugucaugguucagucaaauacugauagguaccuuauuaauguggcuaggauuaaauacaaaaaacgguuccauuagucuuauguguuuagcauuaggcggaguauuaauauucuuaucaacagcaguaucggcagacguaggauguaguguagauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7012 - RNA, 2524 nt, Artificial Sequence
  KX087101.3 prME-long mRNA Design 2 opt
ggggcgcugccuacggagguggcagccaucuccuucucggcaucaagcuuaccaugagaauaauaaaugcccguaaagaaaagaaaagaagaggugcagauacaucaguggguaucguagguuuauuauuaacaacagcgauggcagcggaaguaacaagaagaggcucagcauauuauauguaccuagacagaaacgaugcgggagaagcaauaucuuuuccuacaacacuuggaaugaauaaaugcuauauacaaauuauggacuuaggacacaugugugaugcuacaaugagcuacgaauguccaauguuagaugaaggaguagaaccagaugacgucgauugcuggugcaacacuacgagcacauggguuguuuacgguacaugccaccauaagaaaggagaagcacgaagaucaagaagggcugucacguuaccgucacauucaacaagaaaauugcaaacaagaucacaaacaugguuagagucaagagaauauacaaaacauuuaauuagaguagaaaauuggauuuuuagaaauccagguuuugcacuugcagcagcugcuauagcaugguuauuaggaucaagcacaucacaaaaagucauauauuuagugaugauuuuacuaauugcacccgcauacagcauaagauguauaggaguaucaaauagagacuucguagaaggaaugucgggaggaacuuggguagauguaguauuagaacaugggggauguguaacaguaauggcucaggauaaaccaacuguugauauugaauugguaacaacaacagugaguaauauggcugaaguaagaaguuauuguuacgaagcaaguauaagugauauggcaagugauucaagguguccuacucaaggagaggcauacuuagacaaacaaucugacacucaauauguauguaaacgaacauuagucgaucgagguugggguaauggauguggucuauuuggaaaaggaucgcuaguaacaugugccaaauuugcauguaguaagaaaaugacaggaaaaaguauucaaccagagaacuuagaauaucgaauuauguuaucaguucauggaagucaacauaguggaaugauaguaaaugacaccggucaugaaacggaugaaaauagagcaaaaguugagauaacaccaaauaguccuagagcagaagcaacacuaggagguuucggaagucuagguuuagauugugaaccacgaacaggauuagacuuuagcgaucuauacuacuuaacuaugaacaauaaacacugguugguacacaaagaaugguuucaugacauaccacuaccguggcacgcuggagcugauacuggaacaccacauuggaauaauaaagaagcauugguagaguuuaaagaugcacacgcaaaaagacaaacaguaguaguauuaggaagccaagaaggagcaguacauaccgcauuggcuggugcauuagaggcagaaauggauggugcuaaagguagguuaaguucaggccauuuaaaauguagauuaaaaauggauaaauuaagacuaaaaggugucucauacagcuugugcacagcagcauucacauuuacaaaaaucccugcagaaacauugcauggaacgguaaccguagaauuacaauaugcaggcacagauggaccuuguaaaguaccagcucaaauggcaguagauaugcaaacuuuaacuccaguaggaagauuaauaacugcaaauccagugauaacggaaaguacugaaaacaguaaaaugauguuagaacuugauccgccauuuggagacagcuacauagugauaggugugggagaaaagaaaauaacccaucauuggcaccgaucaggaucaacaauaggaaaggcuuucgaagcaacaguuagaggcgcaaaacgcauggcuguauugggagauacugcaugggauuuuggaaguguagguggggcauuaaacaguuuaggaaaaggaauacaucaaauuuucggcgcagcauuuaaaucauuauucggaggaaugagcugguuuucacaaauacuuauaggaacacuacuaaugugguuagguuuaaauacuaaaaacggaaguauuucauuaauguguuuagcacucggagguguauuaauauuccuaucaacagcaguaucagcagacguaggaugcagcguagacuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7013 - RNA, 2524 nt, Artificial Sequence
  KY075932.1 prME-long mRNA Design 2 opt
ggggcgcugccuacggagguggcagccaucuccuucucggcaucaagcuuaccaugagaauaauaaaugcaagaaaagaaaagaaaagaagaggagcagaaacaaguguaggaaucguuggauuauuauuaacaacagcaauggcagcagaaguaacgagacggggaucagcuuauuacauguauuuggauagaaaugaugcaggagaagcuauuagcuuuccaacaacacuggguaugaauaaauguuauauacaaauaauggacuugggucauaugugcgacgcaacaaugucauaugaaugucccauguuagaugaaggaguagaaccagacgauguagauuguugguguaauacaacaaguacauggguaguauaugguacgugccaucauaaaaagggagaagcaaggagaucaagaagggcaguaacauuaccuagccauagcacucgaaaauuacaaacaagaagucagacgugguuggaaucaagagaguauacaaaacacuuaauacggauagaaaauuggauauucagaaacccagguuucgcucuggcugccgcagcaauugccuggcuauuagggucaagcaccucacagaaagugauuuacuuaguaaugauacuauuaauagcuccugcauacagcauuagauguauaggcguuucaaaccgagacuuugucgaaggaaugucgggagguacaugggucgauguaguauuagagcacggaggaugugugacaguaauggcacaagacaaaccaacagucgacauagagcuaguaacaacaacuguaaguaauauggcagaaguuagaucauauuguuaugaagccaguauaagugauauggcuagugauuccagauguccaacacaaggagaagcauaucuugauaaacaaagcgauacacaauauguuuguaaaagaacuuuaguagauaggggaugggguaacggguguggacuauuuggaaaaggaucuuuaguuacaugugcaaaauuugcauguaguaagaaaaugacaggaaaaucaauacaaccagaaaauuuagaauauagaauuauguugucaguacaugguucacaacauagugguaugauaguaaaugacaccgggcaugaaacagacgaaaauagagcaaaaguagaaauaaccccaaauagcccgagagcagaggcaacauuggguggauuuggaagccuuggacuagauugugaaccaagaacagggcuagauuucagugaccuguacuauuuaacaaugaacaacaaacauugguuaguccauaaagagugguuccaugauauccccuuaccauggcacgcaggagcagacacgggaacaccacacuggaacaauaaagaagcauuagucgaauuuaaagaugcacaugcaaaaagacaaaccguagugguauuaggaucacaagaaggugcaguucauacagcuuuagcuggagcacuugaagcagaaauggauggcgcaaaaggaagauuaucaaguggacauuuaaaauguagauuaaaaauggauaaauugagacuaaaagguguaucauacaguuuauguacagcagcauuuacuuuuacaaaaauaccugcagaaacauuacacgguacaguaacaguagaaguacaauaugcaggaacagacggaccaugcaaagucccggcacaaauggcuguagauaugcaaacacuaacaccagugggaagauuaauuacagcaaauccaguaauaacagaaucaacugaaaauucgaaaaugaugcuagaauuggauccaccauuuggagacaguuauauaguaauugguguuggcgaaaagaaaauaacacaucauuggcauagaucaggaucaacuauaggaaaagcauuugaggcuacagugcgaggagcuaaacgaauggcaguguuaggugauacggcaugggauuuuggaaguguaggcggugcccuaaauucacuuggaaaaggcauacaccaaaucuuuggagcagcauucaaaucgcuauuugguggaaugaguugguuuagucaaauauuaaucgggacuuuauuaaugugguuaggauuaaauacuaaaaauggaagcauaucacuaauguguuuagcguuaggaggaguauuaauuuucuuaagcacagccguaucagcagaugugggaugcaguguagauuucucgaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7014 - RNA, 2524 nt, Artificial Sequence
  KY014317.1 prME-long mRNA Design 2 opt
ggggcgcugccuacggagguggcagccaucuccuucucggcaucaagcuuaccaugagaaucauaaaugcuagaaaagaaaaaaaaagacggggagcagauacaucaguaggaauagugggauuauuacuaacaacugcaauggccgcagaaguuacacgaagagggagugcauauuauauguaucuagaccgaaaugaugcaggagaagcaauaagcuuuccaacaacccuuggaaugaauaaauguuauauacaaauaauggauuuaggacauaugugugacgcaacaaugucauaugaaugcccgauguuagacgaagggguagaaccagacgauguagacugcugguguaauacaacaucaacauggguuguauacggaaccugccaucauaaaaaaggagaagcaagaagaaguagaagggcgguaaccuuaccuucucauucaacuagaaaacuucaaacuagaucacaaacuugguuagaaaguagggaauauacaaaacauuuaauaagaguagagaauuggauuuuuagaaauccaggauuugcauuagcagcagcagcaauagcaugguuacucgguucaucaacaagucaaaaaguaauuuacuuaguaaugauuuuacuaauugcacccgccuacucaauuagauguauaggaguaucaaauagagauuucguagaaggaaugaguggaggcacuuggguugauguaguauuagaacaugguggcuguguaacagucauggcacaagauaagccaacaguagauauagaacuaguaacaaccaccguaucaaacauggccgaaguacgaucguacuguuaugaagcaucaauuagugacauggcaucagauaguagaugucccacacaaggagaagcauaucuagauaaacaaagugauacucaauauguauguaaaagaacauuaguagaucgagguugggguaauggauguggacuauuuggaaaaggaucucuagucaccugugcaaaauuugcuuguucaaaaaaaaugacaggaaaaagcauucaaccagaaaauuuagaauauagaauuauguuaucaguacauggaagccaacauucuggaaugauaguaaaugauacuggacacgaaacagaugagaauagggcaaaaguugaaauaacaccaaauucaccuagagcagaagcaacauuaggcgguuuugguagcuuggguuuggauugugaaccuagaacaggacuagauuuuagugauuuauauuaucuaacaaugaauaauaaacauuggcugguacauaaagaaugguuucaugauauaccauuaccuuggcaugcaggagccgauaccgguacgccucauuggaacaauaaagaagcacuuguagaauucaaagaugcacacgcaaaacgucaaacaguaguaguauuaggaucacaagaaggggcaguacauacggcguuagcaggcgcauuagaagcagaaauggauggagcuaaaggucgucuuucaaguggacauuuaaaauguagguuaaaaauggauaaacuacgauuaaaaggcguaucuuauucauuauguacagcagcauuuacuuuuaccaaaauaccagcagagacccuacauggaacagucacgguagaaguacaauaugcugguacugauggaccauguaaaguaccugcucaaauggccguagauaugcaaacauuaacaccagugggaagacuaauaacagcaaauccgguuauuacagaaagcauagaaaauucaaaaaugauguuagaacuagauccacccuucggugauucauauauaguuauaggcguaggggagaaaaaaauaacgcaucacuggcaucgaucaggaaguacaauaggcaaagcauuugaagcuacuguacguggagcaaaacgaauggccguucucggggacacugcuugggacuucggcucaguaggaggggcgcuaaauagucucggaaaaggcauacaccaaauuuuuggagcagcuuucaaaucauuauucggaggaaugucgugguucagucaaauauuaaucggaacacuacuaauguggcuaggacucaauaccaaaaaugggaguauaaguuuaaugugucuagcauuaggagguguuuuaauauuuuuaucaacugcuguuucagcagacguaggaugcucaguugauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7015 - RNA, 2524 nt, Artificial Sequence
  KU758876.1 prME-long mRNA Design 2 opt
ggggcgcugccuacggagguggcagccaucuccuucucggcaucaagcuuaccaugagaauaauaaacgcaaggaaagaaaagaaaagaagaggagcugauacaucuguaggaauuguaggguuacuauuaacaacagcaauggcugcggagguaacaaggaggggcucagcauacuauauguaucuagaccgaaaugaugcaggagaagcaauaaguuucccaacaacauugggaaugaauaaauguuacauacaaauaauggauuuaggccauaugugcgaugcaacaaugaguuaugaaugcccgaugcuagaugaaggaguugaacccgaugaugucgauuguugguguaauacaacaaguacuuggguaguauacggaacaugucaucauaagaaaggugaagcuagaagaucaaggagagcgguaacacuaccgucacauucaaccagaaaauuacaaacaagaucacaaaccugguuagaaaguagagaauauacaaaacauuuaauaagaguagaaaacuggauauuuagaaauccagguuuugcauuggcugcugcagcuauagcaugguuacuaggaagcucaacaagucagaaaguaauauaucuagucaugauuuuacuaaucgcaccagccuacaguauaagguguauaggaguaucaaauagagacuuuguagaagguaugaguggagguacauggguagacguaguacuagaacacggagguuguguaaccguaauggcccaagauaaaccgacaguagacauagagcuaguaacaacaacaguuucaaauauggcugaaguuagaagcuauugcuaugaagccucaauaagcgacauggcuagugauucaagaugucccacacagggagaagcauauuuagauaaacagucagacacucaauauguauguaagagaacauuaguagacagggguuggggaaauggauguggauuauucggaaaaggaagucuuguaacaugcgcaaaauuugcauguucgaagaaaaugacaggaaaaaguauacaaccagaaaacuuagaauauagaauaaugcuuaguguacauggaagucaacauaguggaaugauaguuaaugauacuggucaugaaacagaugaaaauagagcaaaaguagaaauaacuccaaacagcccuagagcagaagcuacauuaggaggauuugguaguuuaggacuagauugcgagccuagaaccgggcuggacuuuucugauuuauauuacuuaacaaugaacaauaaacauuggcuaguacauaaagaaugguuccaugauauaccuuugccauggcacgcaggggcagauacaggaacaccucauuggaauaacaaagaagcucuaguagaauuuaaagaugcacaugcaaaaagacaaacaguuguuguauuaggaagucaagaaggagcaguacacacagcacuagcaggagcauuagaagcagaaauggauggaguaaaaggccggcuuagcagcggucaucuaaaauguagauuaaaaauggacaaacuaagguuaaaagguguaaguuauagucuguguacugcggcauuuacauuuacaaaaauaccagcagaaacauuacaugguaccguaacaguagaaguacaauacgcaggaacggauggacccuguaaaguuccugcacaaauggcaguagacaugcaaacacuaacaccuguggguaggcuaauaacugcaaauccgguaauaacagaaucaacugaaaauaguaaaaugaugcuugaauuggaucccccuuuuggagacaguuauauaguaauagggguaggagaaaagaaaauaacucaccacuggcauagaagcggaucaacuauagggaaagcguucgaagcaacaguacgaggcgcaaaaagaauggcaguauuaggagacaccgcaugggauuuugguaguguaggaggugcacuuaauagccuaggcaaaggcauacaccaaauauucggagcugcauuuaaaucauuauuuggagggaugagcugguucucacaaauauuaaucggaacauuauuaauguggcuuggacuaaauaccaaaaauggaucaauaucauuuaugugucuagcacuuggcggaguauuaauuuuucuaaguacagcaguuucagcagacguaggcuguaguguagauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7016 - RNA, 2524 nt, Artificial Sequence
  KU758874.1 prME-long mRNA Design 2 opt
ggggcgcugccuacggagguggcagccaucuccuucucggcaucaagcuuaccaugcguauaauaaaugcacgaaaagaaaaaaaaagaagaggagcugacacaucaguuggaauuguaggauuauuauuaacuacagcaauggcagcagaaguaacaagacgaggaucugcuuauuauauguauuuagauagaaacgaugcgggagaagcaauaucauuucccacaacauugggaaugaauaaauguuacauacaaauuauggauuuaggacauaugugugaugcaacaaugagcuaugaauguccaaugcuagacgaaggaguugaaccugaugauguagacuguuggugcaauacuacaucaacaugggucguauauggaacaugccaucacaaaaaaggugaagcuagaagaaguagaagagcaguaaccuuaccaucccacaguacacgaaaacuacaaacaaggagucaaacaugguuagaaucaagagaauauaccaaacaucugauacgaguagaaaauuggauauucagaaacccaggauucgccuuggcagcugccgcgauagcauggcuacuaggaaguucaacuucacaaaaaguaauauacuuagucaugauacuacuuauugcgccagcauauagcauacgauguauaggagucagcaauagagauuuugucgaaggaaugucuggaggaacauggguagacguaguauuagaacauggaggauguguaacaguaauggcacaagauaaaccaacuguagauauugaauuaguuaccacaacaguaucaaauauggcagaaguaagaucauacuguuaugaagcaaguauaagcgauauggcaagugacucaagauguccaacccaaggagaagcauacuuagauaaacaaagcgauacacaauauguauguaaacgaacguuaguagacagaggauggggaaauggauguggucuauucggaaaagguaguuuagugacaugugcaaaauuugcuuguaguaaaaaaaugacaggaaaauccauucaaccagaaaaucuagaauauagaauaaugcugaguguacauggaucacaacacucugguaugauagucaacgacacuggacaugaaacugaugaaaauagggcuaaaguagaaauaacaccuaauucaccaagagccgaagcuacuuuaggugguuuuggcucauuaggcuuagauugugaaccacgaacaggauuagauuuuucagaccuauacuaccuaacaaugaacaacaaacauugguuaguucauaaagaaugguuucacgauauaccacuaccuuggcaugcaggugcagauacuggaacuccacauuggaauaacaaagaagcacuagucgaauuuaaagacgcacaugcaaaacgacaaacaguaguaguuuugggcucucaagaaggugcaguucauacagcacuagcuggugcucuagaagcagaaauggauggagcuaaggguaaacuaaguagcggacauuuaaaaugcagacuaaaaauggauaaauuacgacuaaaaggaguaaguuauucauuaugcacagcggcauucaccuuuacaaaaauaccagcagaaacauuacacggaacaguuacaguugaaguccaauaugcaggaacagauggaccauguaagguaccugcccaaauggcuguagauaugcaaacacuuacaccuguuggaagacuuauuacagcuaaccccguaauaaccgagucaacagaaaacaguaaaaugaugcuagaacuagaccccccauuuggugauaguuauauagugauagggguaggugaaaaaaaaauaacacaucauuggcauaggagcggaucaacaauagguaaagcauuugaagccacaguaagaggugccaaaagaauggcaguguuaggagacacagcaugggacuucggaucagugggcggugcacuaaacaguuuagguaagggaauacaucagauauuuggugcugcauuuaaaucuuuauuuggaggaaugaguugguuuagucaaauuuuaauuggaacacuauuaauguggcuagggcuaaacacgaaaaacggcucaauaucauuaaugugcuuagcauuagguggaguuuuaauauuucuaucaacagcaguuagugcugacguuggaugcuccguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7017 - RNA, 2524 nt, Artificial Sequence
  KY014314.1 prME-long mRNA Design 2 opt
ggggcgcugccuacggagguggcagccaucuccuucucggcaucaagcuuaccaugagaauaauaaacgcuagaaaagaaaagaaaagaagaggagcugauacaagugucgguaucguuggacucuuauuaacaacugcaauggccgcagaagugacacgaagggguagugcauauuacauguauuuagauagaaaugaugcaggagaagcgauaucauuccccacaacacuaggaaugaauaaaugcuauauacaaauuauggauuuaggucacaugugugacgcaacaaugucauaugaauguccaauguuagacgaaggaguagaaccagaugauguagauugcugguguaauacaacaucaacaugggucguauacggaacuugucaccacaagaaaggagaagcuaggagaaguagacgagcaguaacucuaccuagucauucuaccagaaaacuccaaaccagaucacaaacaugguuggaaucaagagaauauacuaaacaccugauaaggguagaaaauuggauauuucguaacccagguuucgcauuagcagcagcagcaaucgcaugguuauuaggaagcagcacaucacaaaaaguaauauauuuagugaugauauuacuaauagcgccugcauauaguauuagauguauaggaguaucaaaucgagacuuuguugaaggaaugucaggaggaacauggguagacguaguucuugaacacggaggauguguaacaguaauggcacaagacaaaccaacgguagauauagaauuaguaacaacgacaguaucaaacauggcagaaguaagaucuuacuguuacgaagcguccauaucagauauggcaagcgauucaagaugcccaacccaaggugaagcauaucuagauaaacaaagugauacacaauauguauguaaaaggacucuagucgacagagggugggguaauggauguggacuauuuggaaaaggaucauuaguaacaugugcaaaauuugcauguucaaagaaaaugaccggaaaaagcauccaaccagaaaaucuugaauaccgaauuaugcuaucaguacauggaucacaacacucaggaaugauaguaaaugacacaggucaugaaacagaugaaaacagggcaaaaguagaaauaacaccaaauucaccuagagcagaagcaacccucggagguuuuggaucauuaggauuagauugugaaccuagaacaggacuagauuuuucagacuuauacuacuuaaccaugaacaauaaacauugguuaguacacaaagaaugguuucaugacauaccuuugccauggcacgcaggagccgauaccggaacaccacacuggaacaauaaagaggcuuuaguagaauuuaaagaagcacaugcaaaacgacaaacaguaguaguauuaggaagucaagaaggggccguacacacagcacuagcaggagcauuagaagcagaaauggauggagcuaaaggaagacuaucaaguggacauuuaaaaugcagacuaaaaauggauaaacuaagacuaaaaggggucagcuacagucuauguacagccgcauuuacauuuaccaaaauaccagcagaaacacuacacggaacaguaacaguagaaguacaauacgcaggaacugacggaccauguaaaguacccgcacaaauggcaguagauaugcagacauuaacuccagucggcagauuaauaacugcaaacccugucauaacagaaaguacagaaaauucaaagaugauguuagaacuagauccacccuucggcgacagcuauaucguuauaggagugggagaaaagaaaauaacacaucauuggcaucgaucagguaguacaauaggaaaggcuuuugaagcaacaguaagaggugccaaaagaauggcuguacuuggagauacagcaugggauuuuggaucaguagguggugcuuuaaauaguuuaggaaaaggaauacaucaaauuuuuggagcagcauuuaaaucauuauuuggaggaaugucaugguucucacaaauauuaauaggaacucuauuaauguggcucggauuaaauaccaaaaaugggucaauaaguuuaaugugccuagcauuaggggguguauuaauauuuuuaucaacagcaguaagugcagauguuggauguucagucgauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7018 - RNA, 2524 nt, Artificial Sequence
  KU926310.1 prME-long mRNA Design 2 opt
ggggcgcugccuacggagguggcagccaucuccuucucggcaucaagcuuaccaugcgaauaauaaaugcuagaaaagaaaagaaaagaagaggagcagauacuucaguuggaauaguagguuuacuucucaccacugcaauggcagcagaaguaacacguagaggcucagcauacuacauguauuuagaucgaaaugaugcaggagaagcaauaucauucccaacaacacucggaaugaauaaauguuauauacaaaucauggauuugggacauaugugugaugccacuaugagcuacgaauguccuaugcuagacgaaggaguagaaccugaugauguagauuguugguguaacacuacaagcacauggguaguuuauggcacaugucaucauaagaaaggugaagcaagaagaucaagacgagcgguuacacugccuucucacucuacaagaaaacuacaaacaagaucacaaacuugguuagaaaguagagaauacacgaaacauuuaauaagaguagaaaacuggauuuucagaaaucccggauuugcuuuagcugcagcagcuauagcuugguuauuaggaagcaguacaagccaaaaaguaauauauuuaguaaugauucuacuuauagcuccagcauauucaauaagguguauaggaguuucaaauagagauuuuguagaaggaaugucagguggaacauggguagaugucguucuagaacauggcggaugcguaacagucauggcacaagauaaaccaacaguagauauugaauuaguaacaacaacuguaaguaauauggcagaaguaagaucguauugcuacgaagcaucaauaagugauauggcaucagacucaagaugcccaacacaaggagaagcauaucuagauaaacaaucagacacgcaauauguuuguaagcgaaccuuaguagauagagguugggguaacgggugcggauuauuuggaaaaggcagucuaguaacaugcgcuaaauuugcguguaguaaaaagaugacuggaaaaucaauucaaccagaaaaucuagaauauagaauaaugcugucaguacaugguucacaacauaguggaaugauaguaaaugacacgggucacgaaacagaugaaaauagagcgaaaguagaaauaacaccaaauagcccacgagcugaagcuacauugggagguuucgguucuuuagguuuagacugcgaaccgagaacaggauuagacuucagcgaucuauauuauuuaacaaugaauaauaaacacugguuaguacauaaagaaugguuucaugacauuccauuaccauggcaugcaggagcagauacagguacaccacauuggaacaauaaagaagcauuaguagaauuuaaagaugcacaugcaaaaagacaaacaguaguaguuuuagguagucaagaaggagcaguucacacagcacuagcuggugcauuagaagcugaaauggauggugcgaaaggaagacugaguuccggacaccuaaaaugcagacuaaaaauggacaaacuaagacuaaaagguguaucauacagcuuauguacagcagcauucacauucacaaaaauucccgcagaaacauuacauggaacaguaacaguugaaguccaguacgcgggugcagaugguccuugcaaaguacccgcccaaauggcagucgacaugcaaacuuuaacaccuguaggaagauugauaacagcaaauccaguaauaacagaaucaacagaaaacaguaaaaugauguuggaacuugauccaccauucggugacaguuacauaguaauagggguuggagaaaagaaaauaacacaucauuggcauagaaguggaagcacaauaggaaaagcauuugaagcaacaguaagaggcgcaaaacgcauggcaguacuuggagauacagcuugggacuuugggagcguuggaggagcccuaaacagucuuggaaaaggaauacaucagauauucggagcugcauucaaaagucuauuuggaggaaugucaugguuuagucaaauauuaaucgguacauuauuaauguggcuaggcuuaaauacgaaaaauggaaguauaagucuuaugugucuagcauuaggugguguacuaauauuuuuaaguacugcagugagugcagacguagguuguucaguugacuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7019 - RNA, 2524 nt, Artificial Sequence
  KU761560.1 prME-long mRNA Design 2 opt
ggggcgcugccuacggagguggcagccaucuccuucucggcaucaagcuuaccaugagaauuauaaaugcaggcaaagaaaaaaaaagacgaggugcagauacuaacgugggaauaguaggauuauuacuaacaacagcgauggcagccgaaguaacuagacgaggaagcgcauauuauauguaucuagaucgaaaugaugcgggagaagcaauaaguuucccaacaacauuaggaaugaacaaaugcuauauacaaaucauggaucuuggacacaugugugaugcaacaaugagcuaugaauguccaauguuagaugaaggaguugaaccugaugacguggauuguuggugcaacacgacaucaacauggguaguauauggaacaugccaucacaaaaaaggcgaagccagaagaagcagaagagcaguaacguuaccuagucauagcacaaggaaauuacaaacaagaagucaaacuuggcuugaaucaagagaauacacaaagcaucucaucagaguugaaaacuggaucuuucgaaauccaggauuugcuuuagcagccgcagccauagcaugguuacuaggaucaucaacaagucaaaaaguaauauacuuggucaugauacuacuaauugcaccagcuuauaguauacguugcauaggaguaaguaacagggauuuuguagaaggaaugucuggaggaacauggguugauguaguccuagaacacggaggauguguuacgguaauggcacaagauaaaccaacaguagauauagaauuaguaaccaccacaguuucaaauauggcagaaguacgaucguauuguuacgaagcuaguauaagugacauggcaucagauucaagaugcccaacacaaggagaagccuauuuagauaaacaaagugacacacaauacguauguaaaagaacacuaguagauaggggauggggaaaugguugcgguuuauuugggaaggguaguuuaguaacgugugcaaaauuugcauguaguaaaaagaugacuggcaaaagcauccaaccugaaaauuuagaauauagaauaauguuaucaguacauggaagucaacacucaggaaugaucguaaacgauacuggacacgaaacugaugaaaaucgagcaaaaguagaaauuacaccaaacucuccacgagcagaagcaacauuaggaggauuuggaucauuaggccuagauugcgaaccccgaacaggacuagauuucagcgauuuauauuauuuaacaaugaauaauaaacauugguuaguacauaaagagugguuucaugacauaccucuaccguggcaugcaggagcagauacugguacaccacauuggaauaauaaagaagcacuggucgaauucaaagaugcacaugcaaaacgacaaacaguaguaguauuaggcagucaagaaggagcgguacauacagcacuagcaggagcccuagaagcagaaauggacggugcaaaaggaagauuaaguaguggacaucugaaauguagauuaaaaauggauaaacuaagauuaaaaggagucucauauucauuauguacagcagcauuuacauuuacaaaaauacccgccgaaacauuacauggaacaguaacaguggaaguacaauaugcuggaacagauggaccuuguaaaguuccagcucaaauggcaguagacaugcaaacauuaacacccguagguagacuaauuacagcaaacccuguaauaacagaaagcacagaaaacucaaaaaugaugcuagaauuagaucccccauuuggugauaguuauauuguuauaggaguuggagaaaaaaaaauaacacaucauuggcacagauccgguucgacaauuggaaaagcauuugaagcuacuguaagaggugcaaggcggauggcgguauugggagacacugcuugggacuucggaucaguuggaggagcacuaaacucacuaggaaaagguauacaucaaauuuuuggugcagccuuuaaaucauuauucggaggcauguccugguucucacaaauacuaauagguacacuucuaaugugguuaggacuaaauacgaaaaauggaucaauaagcuuaauguguuuagcccuagggggaguccuaauauucuuaucaacugcaguaucagcagauguagguuguaguguagauuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7020 - RNA, 2524 nt, Artificial Sequence
  KY317939.1 prME-long mRNA Design 2 opt
ggggcgcugccuacggagguggcagccaucuccuucucggcaucaagcuuaccaugagaauaauaaaugcaagaaaagaaaaaaaacgccgaggagcagaaacuaguguagggauaguagguuuacuuuuaacaacagcaauggcagcagaaguuacaagaagaggaagugcuuauuauauguauuuagaccgcaaagaugcaggagaagcaauaaguuuucccacaacguuggguaugaauaaauguuacauacaaauuauggacuuaggacacaugugcgaugcaacuaugagcuacgaaugcccuaugcuagaugaaggggucgaaccagaugacguugauuguugguguaacacaacaucaacauggguagucuaugguacaugccaucauaaaaaaggugaagcucgacgaucaagaagagcaguaacacuaccuagucauaguacuagaaaacuacaaacaagaagucaaacauggcuagaaaguagagaguauacaaaacaccuaauaagagucgaaaauuggauuuuuagaaacccaggauuugcauuggcggcagcugcuauugcaugguuacuaggaaguucaacuucacaaaaaguuauauaucuaguaaugauacuauuaauagcaccugcguauucaauuagauguauaggaguuucgaauagagauuuuguagaagggaugucagguggaacauggguagacguaguacuagaacacggaggauguguaacagucauggcacaagauaaaccaacaguugacauagaauuaguaacaacaacaguuaguaauauggcagaagucagaucauauugcuaugaagccagcauaucugauauggcaagcgacucaagauguccaacacaaggugaagcguaucuugauaaacaaucagauacccaauauguauguaagcgaacauuaguagauagaggguggggaaauggaugcggacuguuuggaaaaggaagucuagugacaugcgcaaaauucgcauguucaaaaaaaaugacaggaaaaagcauacaaccggaaaauuuagaauauagaauaauguuaaguguacaugguucacaacauaguggaaugauagucaaugauacuggacacgaaacagaugaaaaucgagcaaaaguugaaauaaccccuaauucaccaagagcagaagcuacauuaggagguuuuggaagucuaggauuagacugugaaccaagaacagggcuagacuuuagcgauuuauauuauuuaacaaugaauaauaaacauugguugguacauaaagaaugguuucacgacaucccacuaccguggcaugcuggagccgacacugguacaccacauuggaauaauaaggaagcauuaguagaauuuaaagaugcacacgcaaaaaggcaaacaguuguagucuugggcagucaggagggagcaguucauaccgcucuagcuggagcauuagaagcagaaauggauggagcaaaagguagauuaucaucuggacaccuaaaauguagacuuaaaauggacaaauugagacuuaaaggugucucauauuccuuauguacagcugccuuuacauuuacaaaaaucccagcugaaacauuacauggaacagugacaguggaaguacaauacgcaggaacagauggaccuuguaaaguuccagcacaaauggcaguugauaugcaaacacuaacaccaguuggcagauuaauuacggccaacccagugauaacagaaaguacagaaaauucaaagaugauguuagaacuagauccuccuuuuggagauucauauauugucauaggaguaggagaaaaaaaaauaacucaucauuggcauagaucaggaucaacaauaggaaaagcauucgaagcaacaguuagaggagcuaaaaggauggccguacuaggagacacagcaugggauuuuggaucagugggaggagcauuaaacucauugggaaaagggauacaccaaauuuuuggcgcagcauuuaaaucuuuauuugggggcaugucuugguucagucaaauauuaauuggaacacugcucauguggcuuggacuuaauacaaaaaacggaucaauaagcuuaaugugucuugcauuaggaggaguucuaauauuuuuaaguacugcaguaucugcagauguaggauguaguguggauuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7021 - RNA, 2524 nt, Artificial Sequence
  KY075937.1 prME-long mRNA Design 2 opt
ggggcgcugccuacggagguggcagccaucuccuucucggcaucaagcuuaccaugagaauaauaaacgcaagaaaggaaaaaaaaagaagaggagcagauacaaguguaggaauaguaggcuuacuacuuaccacagcaauggcugccgaaguaacaagaagaggaucagcauauuacauguauuuagauagaaacgaugcaggagaagcaaucucuuuuccaaccacacucgggaugaacaaauguuacauacaaauaauggacuuaggacauaugugugaugcaacuaugaguuaugaauguccuaugcuagaugagggggucgaaccugaugauguugauuguugguguaauaccacuagcacauggguaguguaugguacaugucaucacaaaaaaggugaagcaagaagaucaagaagagcaguaacauuaccaagucauagcaccagaaaauuacaaacaagaucgcaaacaugguuagaaaguagagaauauacuaaacaucuaauaaggguagaaaacuggauauuuagaaauccaggcuuugcauuagcagcggcugcaaucgcaugguuacuagguaguucaacaucacaaaaaguuauauaucuaguuaugauacuauuaauagcaccagcauacucaauaagaugcauaggaguaaguaauagagauuucguagaagguaugagugggggcacauggguugacguuguuuuagaacaugguggauguguuacuguaauggcacaagacaaaccaacuguagauauagaacuaguaacgacaacaguaucaaacauggcugaagugagaucauauuguuaugaagccaguauaagugauauggucagugauucaagauguccaacacaaggugaagcauauuuagauaaacaaucagacacucaauacguuuguaaaaggacucucguagacagaggauggggaaacggauguggauuauuugguaaagggucuuuaguaacaugcgcaaaauuugcguguagcaagaaaaugaccggaaaaaguauucaaccugaaaauuuagaguauagaauuaugcuaaguguacacggaagucaacauucagguaugauaguuaacgauacaggucaugaaacagaugaaaauagagcuaaaguagaaauaacaccaaauucacccagggcagaagcaacauuagggggcuucggaucauuaggacuagauugugaaccucgaacugggcucgauuuuagugaucuuuauuauuugacaaugaauaauaaacacuggcuugugcauaaagaaugguuucacgauauaccauuaccauggcacgccggagcggauacaggaacuccacauuggaacaacaaagaagcauugguagaauuuaaagacgcccaugcuaaaagacaaacagucguaguacuaggaucucaagaaggugcaguacauacagcgcuagcaggagcguuagaagcggaaauggauggugcuaaaggaagauuaagcagcggacaucugaaaugcagauuaaaaauggacaaauuaagauuaaaaggagucucauauucauuauguacagcugcauuuaccuucacaaaaauaccagcagagacuuugcaugguacaguaacaguagaaguacaauaugcuggaacagacggucccuguaaaguaccugcacaaauggcgguagauaugcaaacacuaacucccguaggaagacuaauaacagcuaauccgguuauaaccgaaaguacugaaaauagcaaaaugauguuagaauuggacccaccauuuggagauaguuauauuguuauagguguaggcgaaaaaaaaauaacucaccauuggcauagaagugguaguacaauaggcaaagcauucgaagcaacuguaagaggagcaaaaagaauggcuguacuaggcgauacagcaugggauuucgguagcguaggaggagcacuaaacucuuuagguaaagguauucaccaaauauuuggugcagcauuuaagucccuauucggaggaaugagcugguuuagucaaaucuuaauaggaacucuacuaaugugguuaggacuaaauacaaaaaaugguaguauaaguuuaaugugcuuagcacuuggaggaguauuaauuuuucuaagcacagcaguaucagcagacguuggaugcucuguagauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7022 - RNA, 2524 nt, Artificial Sequence
  LC191864.1 prME-long mRNA Design 2 opt
ggggcgcugccuacggagguggcagccaucuccuucucggcaucaagcuuaccaugagaauuauaaaugcccgaaaagaaaagaaaagaagaggagcagauacaaauguagguauagucggccuacuacuaacaacagcaauggcagcagaaguuacacgccguggaucagcuuauuauauguaccuagauagaaaugaugcaggagaagcgauuaguuuuccgacaacauuagguaugaauaaauguuacauacaaauaauggaccugggacacaugugcgacgcuacaaugagcuaugaaugcccaaugcuagacgaaggaguagaaccagaugacguagacugcugguguaauaugacaucaacaugggucguauauggaacaugccaucauaagaaaggagaagcaagaagaucucggagagcgguaacucucccaagucauaguacuagaaaacuacaaacaagaucucaaaccuggcuagaaucaagagaauauacuaaacaucuaauaagaguagaaaauuggauauuuagaaacccugguuucgcccuagcagcugcugcaauagccuggcuacuaggaaguaguacaagccaaaaaguaauauauuuaguaaugauauuacucauugcuccggcguauaguauuagauguauuggaguaaguaauagagacuucguagaaggaaugucgggaggcacauggguagauguaguacuagaacauggaggauguguaacgguuauggcucaagauaaaccaacaguagauauagaauuagucacuacaacaguaucaaauauggcagaaguaagaucuuacuguuaugaagcaucaauaagugauauggcuagcgacucuagaugcccaacccaaggagaagcauacuuagauaaacaaucagauacacaauauguauguaaaagaacauuaguagacagaggguggggaaauggauguggauuauucggaaaaggaucccuaguaacaugcgcaaaauuugccuguucaaagaaaaugacaggaaaaucaauacaaccagaaaacuuagaauauagaauaauguuaaguguacacgguucacaacauucaggaaugauaguaaaugauaccggucaugaaacugaugaaaauagagcaaaaguggaaaucaccccaaauucaccaagggcagaagccacucuaggaggguuugguucacuaggacuugauugugaaccaagaacaggacuagauuuuucagauuuauauuauuuaaccaugaauaauaaacauugguuaguucauaaagaaugguuucaugauauuccccuuccauggcaugcaggagcagacacaggaacaccucauuggaacaacaaagaagcucuaguagaauuuaaagaugcacacgcaaaaagacaaacuguagucguucuaggaucacaagaaggagcaguacacacagcacuagcaggagcacucgaagcagaaauggauggagcaaaaggacgacuaagcaguggacauuuaaaaugucgacuuaaaauggauaaauuaagauuaaaaggaguaaguuacucauuauguacagcagcauuuacauucacaaaaauacccgcagaaacccuacauggaacaguaacuguggaaguccaauacgcuggcacagauggaccauguaaaguaccagcucaaauggcaguagacaugcaaacauuaacuccaguagguagauuaauaacugcaaauccugucauaacagaaucaacggaaaacuccaaaaugauguuagaacuagacccaccauuuggagacaguuauauaguuauagguguaggugaaaagaaaauuacacaucauuggcauagaaguggaucaaccauaggaaaagccuuugaagcaacaguaagaggagccaaaaggauggcaguacuuggagacacagcaugggacuuuggaagcguaggaggagcauuaaacagccugggaaaaggaauacaucaaauauucggagcagcauuuaaaagccuuuuuggagguaugucgugguucucccaaauccuaauuggaacucucuuaauguggcuaggacuuaauaccaaaaacggaucaauaucauuaaugugucuagcauuaggagguguacuaauauuucuaaguacagcaguaucagcagacguaggauguucaguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7023 - RNA, 2524 nt, Artificial Sequence
  KX447517.1 prME-long mRNA Design 2 opt
ggggcgcugccuacggagguggcagccaucuccuucucggcaucaagcuuaccaugagaauaauaaacgcuaggaaagaaaaaaaaagaagaggggcagacacaaguguagggauagucggacuauuauuaacuacagcaauggcagcagaaguuacaaggagagguucugcauacuauauguauuuagaucgaaaugacgcaggcgaggcuauaaguuuucccacaacucucggaaugaauaaauguuauauucaaauaauggaucuuggacacaugugugaugcaaccaugucauaugaauguccaauguuagaugaaggaguagagccagacgauguagacuguugguguaacacuacaucaacuuggguaguuuacggaacaugucaucauaaaaaaggagaagcgagaaggaguagaagagcaguaacauuaccuucacauucaaccaggaaauuacaaacaagaagccaaaccugguuagaaucaagagaauauacaaagcauuuaauacgcguggaaaacuggauauuuaggaacccaggcuucgcuuuagcagcggcugcgauagcauggcuccucggaucaucaacgucacaaaaaguaauauauuuaguaaugauuuuauugauagcaccagcauauucaauacgauguauuggcgugucaaaucgagauuuuguugaaggaauguccggaggaacuuggguagauguaguauuagaacauggaggauguguaacaguaauggcacaagacaaaccuacaguugauauagaauuaguaacaacaaccguaucaaauauggcagagguaagaagcuauuguuaugaagcuucaauaucagauauggcuucagauagcagauguccaacacagggagaagcuuaucuagacaaacaaucagacacacaauauguauguaaaaggacacuaguagauagagguuggggaaaugguuguggucuuuucgguaaaggaagcuuaguaaccugcgcaaaauuugcuuguaguaaaaaaaugacuggaaaaagcauucaaccagaaaauuuagaauauagaauaauguuaaguguacacggcucucagcauagcggaaugauaguaaaugauaccggccacgaaacugacgaaaauagagccaaagucgaaauuacuccuaauucuccaagggcugaagcugcauuaggugguuuuggaucgcuaggccuugacugcgaaccaagaacaggauuagacuucagugaucuauauuauuuaaccaugaauaauaaacacugguuaguccauaaagaaugguuccaugauauaccgcuaccauggcacgcaggugcagauacagguaccccacacuggaauaauaaggaagcauuagucgaauuuaaagaugcacacgcgaaaagacaaacaguaguaguauuaggaucacaagaaggggcuguacacacagcacuagcuggagcacuagaagcagaaauggauggugccaaaggcagauuaaguaguggacaucuuaaauguagacuuaaaauggauaaauuacgacuuaaagguguaaguuauucacuauguacagcagcauuuacuuuuacuaaaauuccagcagaaacacuucauggcaccguaacuguugaaguacaauacgcaggaacugaugguccuuguaaaguuccagcacaaauggcaguggauaugcaaacauuaaccccaguaggcagauugauaacugcaaauccgguaauuacagaaaguacagaaaacaguaaaaugaugcuugagcuugauccaccauuuggggacucuuacauaguaauaggagucggugaaaaaaaaauaacacaccacuggcacagaucagguucaacuauaggaaaagccuucgaagcuacaguaagaggugcaaaaagaauggcaguauuaggagauacagcaugggacuucggaucuguaggaggagcauuaaauucauuaggaaaaggaauacaucaaaucuucggagccgcauuuaaaagucuauucgguggaaugucuugguuuagccaaacauuaauaggcacuuuauuaauguggcuagguuuaaauacaaaaaaugguucaauuaguuuaauguguuuagcauuaggagguguacuaauauucuugaguaccgcaguaucagccgaugucgguuguucuguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7024 - RNA, 2524 nt, Artificial Sequence
  KU922923.1 prME-long mRNA Design 2 opt
ggggcgcugccuacggagguggcagccaucuccuucucggcaucaagcuuaccaugaggauuauaaacgcacgaaaagaaaaaaaaagaagaggggcagaaacaagcguaggaauuguaggucuacuauuaacaacagcuauggcugcugaaguaacacgaagaggaucagcauauuacauguauuuagauagaaaugaugcgggagaagcaaucucauucccuacaacguuagggaugaauaaauguuauauccaaauaauggaucuaggccacaugugcgaugcuacaauguccuaugagugcccaaugcuagaugaaggaguagaaccagaugauguagauuguugguguaauacaacaaguacauggguaguauaugguacaugucaccacaaaaaaggagaagcgaggcggucaaggagagcaguuacauuaccaucacacaguacaagaaaacuacagacacgaucacaaacaugguuggaaaguagggaauacacuaaacaucuaauacguguugaaaauuggaucuuuagaaacccaggguucgcucuagcagcggcagcuauagcaugguuacuagguucuucaacaucgcaaaaaguaauauaccucguaaugauucuacuaauagccuuagcuuacucaauaagaugcauaggcguauccaauagagauuuuguagaaggaaugucaggaggaacuuggguagauguaguuuuagaacacggaggcuguguaacaguaauggcacaggacaaaccuacaguagauauagaauuaguaacaacaacaguaucuaauauggcagaaguucgaucauauuguuaugaagcaucgauuucagauauggcaagcgauaguagauguccuacgcaaggugaagcauauuuagauaaacaaucugauacucaauauguaugcaaaagaacauuaguagauagggguuggggaaauggauguggacuauucggaaaaggaagcuuggucacuugugcaaaauuugcauguucaaaaaaaaugacaggaaaaucaauacaaccagaaaacuuagaauacagaauaaugcugagcguacauggaagccaacauagcggaaugauaguaaacgacacaggacaugaaacagaugaaaacagagcaaaaguagaaauaacucccaauucaccaagagcagaagcaacucucggaggauucggaagcuuaggacuagacugugaaccgagaacaggucuagacuucucugaucucuacuaucuaacuaugaauaacaaacauuggcuaguucauaaagaaugguuccaugacauaccauuaccauggcaugcuggagccgauacaggaacaccacauuggaacaauaaagaagcucuaguugaauuuaaagaugcacaugcaaaaagacaaaccgucguuguauuaggaucacaagagggagcuguccauacagcauuagcaggagcauuagaagccgaaauggauggagcaaaaggaagacuaucaucaggacauuugaaauguagauuaaaaauggauaaauuaagacuaaaagggguaucauacucacuauguaccgcagcauuuacauuuaccaaaauaccagcagaaacauuacauggaacaguuacaguggaaguccaauaugccggaacugaugguccaugcaagguacccgcccaaauggcaguagacaugcaaacacuaacaccagugggaagauuaauaaccgccaauccaguaauuacagaaucaacagaaaauucaaaaaugaugcucgaauuagauccgccauucggagauagcuacauuguuauuggaguaggagaaaaaaaaauuacacaccauuggcaccgaagcggaagcacuauuggaaaagcauuugaagcuacuguaagaggagcaaaacgaauggcaguacuuggagauacugcuugggauuuuggaaguguagguggcgcacuaaacagcuuagguaaaggaauacaucaaauauucggcgccgcauucaaaagcuuguuugggggaaugucaugguucucacaaauauugauagguacacuuuugauguggcuaggacuaaauacaaaaaacgguucaauaagucuuaugugucuagcccucgguggaguacuuauauuuuuaaguaccgcaguaagcgcagauguuggcuguaguguagacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7025 - RNA, 2524 nt, Artificial Sequence
  KY003156.1 prME-long mRNA Design 2 opt
ggggcgcugccuacggagguggcagccaucuccuucucggcaucaagcuuaccaugagaauaauaaaugcgagaaaagaaaaaaaaagaagaggagcugauacaaguguuggaauugugggucucuuauuaacaacagcaauggcagcagaaguaacaagaagagggucagcauacuauauguaucuagauaggaaugaugccggcgaagcuauaucauuuccuacaacauuaggaaugaauaaaugcuauauacaaauaauggaucuuggucauaugugugaugcaaccaugaguuaugaauguccgauguuggacgaaggaguugaaccagaugauguagacugcugguguaauacaacaaguacaugggucguauauggcacaugucaucauaaaaaaggagaagcgagaagaucgcguagagcuguaacacuaccaucacauaguaccagaaaacuacaaacgagaagucaaacauggcuagaaucaagagaauauacaaaacacuuaauacgaguagaaaauuggauauuuagaaacccaggauucgcauuagcagcagcggcaauugcaugguuauuaggaucaaguacgagucaaaaaguaauauauuuaguaaugauacuauuaauagcaccugcauacucaauaagauguauaggaauaaguaaucgagauuucguggaaggaaugucaggagguacauggguagauguaguucuugaacauggaggauguguaacuguaauggcccaagacaagccaacaguagauaucgaauugguaacaacgacaguuaguaauauggcagaaguacgaaguuauuguuacgaagcaucuauuucugauauggcaucagacaguagauguccaacacaaggagaggcuuaucuggacaaacaaagugacacacaauauguauguaaacguacgcuaguugaucgaggauggggaaacggauguggguuauucggaaaagggaguuuaguaacaugugcaaaauuugcauguucgaaaaagaugacgggaaaaagcauacaaccagagaauuuggaauauagaauaaugcuaagugugcacggaucacaacacucagguaugauagucaaugauacuggacaugaaaccgaugaaaaucgugcaaaaguagaaauuacaccaaauaguccaagagcagaagcaacacuaggcggauucgggauauuaggauuagauugugaaccaagaacaggacuagauuuuagcgaucuauacuacuuaaccaugaauaacaaacauugguuaguacauaaagagugguuccaugauaucccucuuccauggcacgcuggugcagauacaggaacaccacauuggaacaacaaagaagcacuaguagaauuuaaagaugcacacgcaaaaagacaaacaguaguaguauuaggaagccaagagggagcaguacauacagcacuagcaggugcauuagaagcagaaauggacggagcgaaagguagauugaguaguggacauuuaaaaugcagauuaaaaauggacaaacuaagacuuaaaggaguaaguuacagucuuuguacagcagcauuuacuuucacaaaaauaccagcugaaacacuucauggaacaguuacuguagaaguucaauaugcagguacagauggaccauguaaaguacccgcacaaauggcaguagauaugcaaacccugacaccaguaggcagacuaauaacagcgaacccaguaauaacagaaagcaccgaaaacucaaaaaugaugcuagaauuagacccaccauuuggagacaguuauauaguuauagguguuggagaaaaaaaaauaacacaucacuggcacagaagugguaguacaauaggcaaagcauuugaagcuacugucagaggcgcaaaaagaauggccguauuaggagauacagcaugggacuuugggagcguuggaggugcauugaauagccucgguaaagggauccaucagauauuuggagcagcauuuaaaagcuuauucggaggaaugucaugguucucacaaauauuaauugguacauuauuaaugugguuagguuugaacacaaagaaugguucaauuucauuaaugugcuuagccuuaggaggaguauuaauauuucuuaguacagcaguaucggcugauguuggauguuccguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7026 - RNA, 2524 nt, Artificial Sequence
  KU312313.1 prME-long mRNA Design 2 opt
ggggcgcugccuacggagguggcagccaucuccuucucggcaucaagcuuaccaugagaauaauaaaugcaagaaaagaaaagaaaagaagaggagcagauacaaguguaggaauagugggucuauuauuaacgacugcaauggcagccgaagugacaagacgaggaagcgcauauuauauguaucuagauaggaaugaugcuggagaagcaauuucauuuccaaccacuuuaggaaugaauaaaugcuauauucaaauaauggaucuaggacauacaugugaugcaacaaugaguuaugaauguccaauguuagaugaaggcguagaaccagaugacguagacuguugguguaauacuacaaguacuuggguagucuauggaacaugccaucauaagaaaggagaagcucgacggucacguagagccguaaccuuaccuucucacucaauaagaaaauuacaaacacgaagucaaacauggcuagaaagcagagaauauacaaaacaucuaauacgagucgaaaauuggauauuucgaaauccgggauuugccuuagccgcggcagcaauagcgugguuacucgguaguucaacaucacaaaaaguaauuuacuugguaaugauacugcuuauagccccagccuacucaauaagauguauaggaguaaguaauagagauuuuguugaaggaaugucaggcggaacuugggucgauguaguauuagaacacggcgguugugugacaguuauggcccaagacaaaccaacaguagauauagaauuaguaacaacuacaguauccaauauggcagaaguaagaaguuauuguuaugaagcaucaauaucggauauggcauccgauaguagaugucccacacaaggagaagcauaucuagauaaacaaucagacacacaauauguauguaaacgcaccuuaguagacagagguuggggaaacggauguggauuauuuggaaaaggaagucucgugacuugcgcuaaauuugcauguagcaagaaaaugacaggcaaaaguauacagccagaaaauuuagaauauagaauaauguuaaguguacauggaagucaacauaguggaaugauuguaaaugauacaggacaugaaacagaugaaaacagagcaaaagucgaaauaacaccaaacucaccacgagcagaagccacacuaggaggauuuggaagccuaggcuuagauugugaaccaagaacaggacuagacuuuucagauuuguacuauuuaacuaugaauaauaaacacuggcuaguucauaaagaaugguuccaugacauaccauuaccauggcacgcuggugcagauacagggacaccacacuggaauaauaaagaggcuuugguagaauuuaaagaugcucacgccaaaagacaaacaguaguaguauuaggaucacaagaaggagcuguacauacagcauuagcuggugcguuagaagcagaaauggauggagcaaaaggucgauuaagcucaggacacuuaaaauguagauuaaaaauggacaaauuaagacuaaaagguguaucauauagucuaugcacagcugcauucacauucacaaaaauacccgccgaaacacuucaugguacagucacagucgaaguccaauaugcaggaacugauggaccaugcaaaguaccugcgcaaauggcuguagacaugcaaacgcuaacuccaguaggaagauuaauaacagcaaauccagucauuacugaaucaacugaaaauaguaaaaugaugcuagaauuagauccaccauuuggugauuccuauauaguaauaggcguaggugaaaagaaaauaacucaucauuggcacagaagugggucaacuauaggaaaggcuuucgaagccacaguaagaggugcaaaaagaauggcaguauuaggagacacagcaugggacuuuggaaguguaggaggagcauuaaacagucuagguaaaggaauacaucaaauauuuggagcagcauucaaaucauuauucggcggaaugagcugguuuucacaaauauuaauaggaacccucuuaaugugguuaggacuaaaugcuaaaaauggaucaauuucacuuaugugucucgcacuaggaggaguccuaauauuuuugucgacagcaguaucagcagauguagguuguucuguggacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7027 - RNA, 2524 nt, Artificial Sequence
  KY075935.1 prME-long mRNA Design 2 opt
ggggcgcugccuacggagguggcagccaucuccuucucggcaucaagcuuaccaugagaaucaucaaugcuagaaaagaaaaaaaaagacgcggggcagauacaaguguuggaauuguaggauuguuacuaacaacagcaauggcagcagaaguaacaagacgagggagugcauauuacauguaucuagauaggaaugaugcaggggaagcuauaagcuuuccaacaacucuagguaugaauaaaugcuauauacaaauaauggaccugggucauaugugugaugcaacaaugagcuaugaauguccaauguuagaugaaggaguagaaccagaugacguagacuguuggugcaauacaacaaguacauggguaguauauggaacaugucaucauaaaaaaggagaagcacaacgaagcagaagagcuguaacacuaccaagccacucuacuagaaaauuacaaaccagaucacaaacguggcuggaaucacgugaauauacaaaacaucuuauuagaguagaaaauuggauauucagaaauccgggguuugcauuagcagcagcugcaauagcaugguuacuagguaguucuacuucccaaaaagucauauacuuaguuaugauauuauuaauagcaccagcuuacagcauacgauguauaggcguuaguaauagggauuuuguagaagguaugucaggaggcacauggguagauguaguuuuagaacacggcggaugugucacuguaauggcgcaagacaagccaacaguagacauagagcuuguuacaacaacgguaucaaauauggcagaagugaggucauauuguuacgaggcaucaauaagugauauggcaucagauucaagauguccaacacaaggagaggccuauuuagauaaacaaagcgauacacaauacguaugcaaaagaacacugguugauagaggauggggaaauggauguggacuguuuggaaaaggaaguuuagugacaugcgcgaaauuugccuguuccaaaaaaaugacaggaaaaagcauacaaccagagaauuuagaauauagaauaauguuaagugugcacggaagucaacacaguggaaugauuguaaaugacacaggucacgaaacagaugaaaauagagcuaaaguggaaauaacgccuaauucaccaagggcagaagcaacauuaggaggauucggaaguuuagggcuagacugugaaccaaggacaggguuagauuuuagcgaucuguauuaucugacgaugaacaacaaacauugguuaguacauaaagaaugguuccacgauauaccauuaccguggcaugccggagcagacaccggcacaccacauuggaauaauaaagaagcauuaguagaauuuaaagacgcacaugcaaaacgucaaacaguaguaguucuaggaagucaagaaggugcaguacacacugcauuagccggagcacuagaggcggaaauggacggagcaaaaggucgacuuucaaguggucaucuaaaauguagauuaaaaauggacaaacuucgacuaaaaggaguaucuuauaguuuaugcacagcagcauucacauuuacgaaaauuccagcagaaacauuacauggaacagugacuguagagguacaguacgcgggaacagauggaccauguaaagugccagcacaaauggcaguugacaugcaaacauugacaccaguaggacgacucaucacagcaaaucccguaauaaccgaaucaacggaaaauucaaaaaugauguuggaauuagacccaccauuuggggacaguuauauuguaauaggaguuggagaaaaaaaaauuacucaucacuggcacaggagcggaucaacaauagguaaagcguucgaagcaacuguucgaggagccaaacgaauggcaguauuaggagauacagcaugggauuuugguucaguaggaggagcauuaaacaguuuaggaaaaggaauacaccaaauauuuggagcggcauuuaagucauuguuuggagggaugucaugguucucacaaauacuaauaggaacacuguuaaugugguuaggauuaaauaccaaaaacggcaguauuaguuuaaugugcuuagcacuaggaggaguguuaauauucuuaaguacugcuguaagugccgauguaggcuguagugucgacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7028 - RNA, 2524 nt, Artificial Sequence
  KY014320.1 prME-long mRNA Design 2 opt
ggggcgcugccuacggagguggcagccaucuccuucucggcaucaagcuuaccaugagaauaauaaacgcaagaaaagaaaaaaagagaagaggagcagauaccaguguagguauuguaggucuguuauugacaacagcuauggcagcagaaguaacaagaagaggaagugcuuauuacauguauuuagauagaaaugaugcaggagaagcaauaucauucccaacaacauuaggaaugaauaaaugcuauauacagauaauggacuuaggacacaugugugaugcaacuaugucguaugaauguccaaugcuagaugaaggaguagaaccggaugauguugauugcugguguaauacaacgucaacauggguaguuuauggaaccugucaucauaagaaaggggaagcuagacguucaagaagagcaguaacccuaccaucacacagcacgcgaaaauuacaagcaagaucacagacuugguuagaaucacgagaauauacgaaacacuuaauacgaguagagaauuggauauuuagaaauccaggauuugcauuagcagcagccgcuauagcaugguuacuuggaucaucaacaucccaaaaaguaaucuaccuaguaaugauacuauuaauagcaccagcuuauaguauuagauguauaggaguaaguaauagagauuuuguugaaggaaugagugguggaacguggguagauguaguauuagaacauggcggauguguaaccguuauggcacaagacaaaccaacaguggacauagaacuaguuacaacaacuguaagcaacauggcggaaguaaggucauauuguuacgaagcuagcauaagugacauggcaucagauaguagauguccaacacaaggcgaagccuaucuagauaaacaaucagacacacaauauguauguaagagaacacuuguagaucguggauggggaaacgguuguggauuguuugguaaaggaucacuaguuacuugugcaaaauucgcauguaguaaaaaaaugacgggaaaaagcauacaaccagaaaauuuagaguacagaauaaugcugaguguucaugguucacaacauucaggaaugauaguaaacgauacaggucacgaaacugaugaaaacagagcgaaaguagaaauaacuccaaauaguccuagagccgaagcaacuuuaggcgguuuugguucauuaggauuagacugugaaccaagaacuggauuagauuucucugauuuauacuacuuaacuaugaauaauaaacauuggcuaguccauaaagaaugguuucaugacauaccauuacccuggcacgcaggugccgacacagguacaccacauuggaauaauaaagaagcauuaguugaauuuaaagaugcacaugcaaaaagacaaacaguaguaguauuagggagucaagaaggagcaguacauacagcuuuagcaggggcauuggaagcagaaauggauggcgcuaaagguagacuaucaucuggacacuuaaaaugucgacuaaaaauggauaaauuaagacuuaaaggaguaaguuauagccuaugcacggcagcguuuacauuuacaaaaauaccugcugaaacuuuacauggcacaguuacaguagaaguacaguaugcgggaacagauggucccuguaaaguaccagcucaaauggcuguagauaugcaaacguuaacaccaguaggcagauuaauaacagcaaacccaguuauaacagaaaguaccgaaaauagcaaaaugauguuggaauuagauccaccuuuuggagauucauauauaguaauaggaguuggagaaaaaaaaauaacacaucauuggcauagaaguggaucaaccauaggcaaagcuuuugaggcaacaguaaggggagcaaaacgaauggcaguauuaggagauacagcaugggauuuugguucaguaggaggagcacucaauagucuuggcaaaggcauacaucagauauuuggagccgcuuucaaaucauuauuuggugggaugucaugguucucacaaauucugauaggaacacuguuaaugugguuaggccuuaauacgaaaaauggaucaauuagcuuaaugugcuuagcauuaggaggaguacuaauuuuuuuaucaaccgcaguaagcgcugauguagggugcaguguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7029 - RNA, 2524 nt, Artificial Sequence
  KX827309.1 prME-long mRNA Design 2 opt
ggggcgcugccuacggagguggcagccaucuccuucucggcaucaagcuuaccaugagaauaauaaaugcacgaaaagagaagaaaagacggggcgcagacacaagugucggaauuguaggauuacuucuaacaacagcaauggcagcagaaguaacaagaagaggaagugcauauuauauguaucuggauagaagcgaugcaggagaagcaauuagcuucccaacaacguuagguaugaauaaaugcuacauacaaauaauggauuuaggacauaugugcgacgcaacaaugaguuacgaauguccaaugcuggaugaaggaguagaaccagacgauguggauuguuggugcaacacuacaaguacuugggugguauauggaacuugccaucacaagaaaggugaagcaagaagaucaaggagagcuguuacguuaccaucacacaguacaagaaaauuacaaacaagaagucaaacauggcuggaaaguagagaauacacaaaacacuuaauaagaguugaaaauuggaucuuuaggaacccaggauuugcacuagcugcagcagcaauagccuggcuacuagguaguaguacaagccaaaaaguaauauauuuagucaugauccuauuaauagcaccagcauacucuauaagauguauaggaguaagcaauagagauuucguagaaggaaugucuggaggaaccuggguagauguaguuuuagaacacggaggcugcguaacaguuauggcccaagauaaaccgacaguugauauagaacuuguaacaacaacgguaaguaauauggcagaaguaagauccuacuguuacgaagcaaguauaagugacauggcuucagauucaagauguccaacacaaggggaagcguaccuugauaaacaaucugauacacaauauguuuguaaaagaacccuaguagauagagguuggggaaauggauguggacuuuuuggaaaagggaguuuaguuacaugugcaaaauucgcauguaguaagaaaaugacagguaaaaguauacaaccagaaaauuuggaauacaggauaauguuaaguguccauggaagucaacauagcggaaugauagucaaugauacggggcaugaaacagacgaaaacagagcaaaaguagaaauaacaccuaauuccccgcgagcagaagcaacauuagguggauuuggcucauuaggauuagauugcgaaccaaggacuggauuagauuuuagugauuuguauuauuuaacaaugaacaauaaacauuggcuuguucauaaagaaugguuucaugauauuccacuaccauggcacgcaggagcugauacaggcaccccacauuggaauaauaaagaagcauuggucgaauuuaaagaugcucaugcaaaaagacaaacgguaguaguauuaggaucacaagaaggagcaguacauacagcacuugcuggugcuuuagaagcagaaauggauggagcaaaaggucgauuaaguaguggacauuuaaaauguagauuaaaaauggacaaauugagacuaaaaggugucuccuauagcuuaugcacagcagcauuuacauuuacaaaaaucccagcagaaacauuacauggaacuguaacuguugaaguacaauaugcagguacagauggcccguguaaaguuccagcucagauggcuguugauaugcaaacauuaacaccugucggaagauuaauaacggcaaaucccguaaucacggaaaguacugaaaauaguaaaaugaugcuagaauuagauccaccauuuggggacagcuauauaguaauaggaguaggugaaaagaaaaucacacaucauuggcauaggaguggaagcacaauaggaaaagccuuugaagcaacaguaagaggagcaaaacgaauggccgugcuaggugauacagcaugggauuucggaucaguggguggagcucucaauuccuuaggaaaagggauacaucaaauauuuggagcugcauuuaaaagucuauuuggggguaugucuugguuuagucaaauauuaauuggaacauuacuuauguggcugggauuaaacacuaaaaaugguucgauaaguuuaauguguuuagcauuaggugggguuuuaauuuuucuaaguacagcaguauccgccgauguggguuguaguguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7030 - RNA, 2524 nt, Artificial Sequence
  KU681081.3 prME-long mRNA Design 2 opt
ggggcgcugccuacggagguggcagccaucuccuucucggcaucaagcuuaccaugagaauaauaaaugcaagaaaagaaaagaaaagaagagguacagacaccaguguaggaauaguaggauuacuauugacaacagcaauggcugcagaaguuacacgcagaggaucugcuuacuauauguaccuagauagaagugaugcaggagaagccauuucauucccaacaacuuuagguaugaauaaauguuauauacaaauaauggaucuaggacacaugugcgacgcaacuaugaguuaugaaugcccuaugcuagaugaaggaguagaacccgaugauguugauuguugguguaacacaacaaguacauggguaguauacggaacaugucaucauaagaaaggcgaagcaagaagaagcagacgagcaguuacauuaccgagccauucaacaagaaaacuacaaacaagaucucaaaccugguuagaaagucgagaauauacaaaacauuuaauuagaguagaaaacuggauauucagaaauccaggauuugcuuuagcagcugcagcuauagcauggcuacuaggaucauccacaucacaaaaaguuauauacuuaguaaugauucuauuaauagccccagcauauucaauaagaugcauagguguaaguaauagagauuucgucgaaggaaugaguggaggaacauggguugacguaguacuagaacauggaggcuguguaacaguaauggcccaagauaaaccgacuguagauauagaauuaguaacaacaacaguaaguaauauggccgaagucagaucauacuguuaugaagccagcauaagugauauggcaagcgauuccagauguccaacucaaggugaggcauauuuagauaaacaaucggauacacaauaugugugcaaaagaacucuaguagacagaggauggggaaacggcuguggauuauuuggaaaaggaagucuaguaacaugugccaaauuugcaugcucaaagaaaaugacuggaaaaucaauacaaccagaaaaucuagaauaucgaauaauguuaagugugcauggaagucaacacagcggaaugauaguaaacgauacuggucaugagacagacgaaaacagagcaaaaguagaaauaacaccuaauucaccacgagcagaagcaaccuuaggaggcuucggaucccuaggauuagauugugaaccacgaacaggcuuagacuuuagugauuuauauuauuuaacaaugaauaacaaacauuggcugguacauaaagaaugguuucacgauaucccauuaccauggcacacaggugcagauacaggaacaccacauuggaacaacaaagaggcgcuuguagaauuuaaagaugcucacgcaaaaagacaaacaguuguaguauugggaucucaagaaggcgcaguacauacagcauuagcuggagcucuagaagcagaaauggacggugcaaaaggccgacugucuucuggucacuuaaaaugcagacucaaaauggauaaauuaagacuuaaaggcguaucauacaguuuauguaccgcugcuuucacauuuacaaaaauaccagcugaaacuuuacauggaaccguaacaguagaagugcaauacgcugguacugauggaccauguaaagugcccgcucaaauggcaguagauaugcagacacuaacaccagugggacgauuaauuacugcaaauccaguuauuacagaaggaacagaaaacucaaaaaugauguuagaauuagauccaccauuuggugauucauauauaguaauaggaguaggugagaaaaagauuacacaucauuggcauagaucaggaucaacaauagggaaagcguucgaagcuacaguaagaggagcuaaaagaauggcaguauuaggagacacggcaugggauuuuggaucaguggguggaguacucaauucauugggaaaaggaauacaccaaauauucggagcagccuucaaaagccuauuuggaggaaugaguugguuuagucaaauacucauaggaacauuguuaauguggcuaggcuuaaauacuaaaaauggcaguauaucacuaaugugucuugcacugggaggaguacuuauauuucuaucaacagcuguauccgcagauguaggauguagcguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7031 - RNA, 2524 nt, Artificial Sequence
  KU744693.1 prME-long mRNA Design 2 opt
ggggcgcugccuacggagguggcagccaucuccuucucggcaucaagcuuaccaugagaauuauaaaugcaaggaaagaaaaaaaaagaaggggagcugauacaucaguaggaauaguuggucuucuacuaacuacagcaauggcagcggaaguaacgcgaagaggaucagcauauuauauguaucuagauagaaaugaugcaggagaggcaaucucuuuuccuacaacauuaggaaugaacaaauguuacauacaaauaauggacuugggacauaugugcgaugcaaccaugucauaugaauguccuauguuggaugaagguguagaaccugaugacguugauuguuggugcaauacaacaucaacauggguaguauacgggacaugucaucacaaaaaaggugaagcuagaagaucaagaagagcuguuacauuaccuucacacucaacacgaaaauuacaaacaagaucacaaacaugguuagaaucaagagaauauacaaaacaccuaauaagaguagaaaauuggauauuuagaaauccagguuuugcauuagcagcagcagcaauagcaugguuauuaggauccucaacgagucaaaaaguuauuuauuuaguaaugauuuuguuaauugcuccagcuuauucaauaagaugcauagguguaaguaaucgagacuuuguagaagggaugaguggugggacauggguagauguaguauuagaacacggcggaugcguaacggcaauggcgcaagacaaaccaacaguagauauagaacuaguuacaacuacgguuucuaacauggcagaaguaagaucuuauugcuacgaagcaucaauaucagacauggcaucugauaguagauguccaacacaaggggaagcauaucuagauaaacaaucagauacacaauauguauguaaacgaacucuaguagaccguggcugggguaacggaugcgggcucuuuggaaaaggaucauuaguaacaugugcaaaauuugcuuguuccaagaaaaugacaggaaaaagcauacaaccagaaaaccuugaauauaggauaauguuaucaguacauggcucacaacauagugguaugcuuguaaaugauacaggacaugaaacggacgaaaaccgagcaaaaguugaaauaacuccaaauaguccgcgagcugaagcaacguuaggcggauuuggaagcuuagggcuagauugugaaccaagaacaggauuggauuucucagaucuuuauuauuuaacaaugaauaauaaacauugguuagcacacaaggaaugguuccaugauauaccccuaccauggcaugcaggugcagccacgggaacuccucauuggaacaauaaagaagcauuaguagaauuuaaagacgcacacgccaaaagacaaaccgucguuguacuuggaucacaagagggagcaguacauacagcauuagcaggagcauuggaagcagaaauggauggugcuaaaggaagauuaucuagcggacaucuaaaaugcaggcuaaaaauggacaaacuacgauuaaaagguguaagcuauagucuaugcacagcagcuuuuacauuuacaaaaauacccgcagagacuguugacgguacaguaacaguagaaggucaauauggagggacugaugguccuugcaaaguuccagcacaaauggcagucgacaugcaaacacuaacgccaguugguagacuaauaacagcgaaucccgucauuacagaaucaacagaaaauucuaaaaugauguuagaauuagauccaccauuuggcgauagcuauauaguuaucggaguaggcgaaaaaaaaauaacucaucauuggcaccggaguggaagcacuauaggaaaagcauucgaagccacaguaaggggugcaaaaagaauggcagugcuaggagauacugcaugggauuuuggaaguguagggggcgcauuaaauaguuuaggaaaaggaauacaucaaauaauaggugcagccuuuaaaagucuauucggaggaaugaguugguuuagccaaauauuaauaggaaccuuacugaugugguuaggacuuaacacgaaaaauggaagcauaucacuuaugugucucgccuugggaggaguauuaauauuucuaucgacggcaguaagcggcgggguagguuguucaguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7032 - RNA, 2524 nt, Artificial Sequence
  KY328290.1 prME-long mRNA Design 2 opt
ggggcgcugccuacggagguggcagccaucuccuucucggcaucaagcuuaccaugagaauaauaaacgcaagaaaagaaaaaaaaaggagagguacagauacauccgucggaauaguggguuuauuacuuacaacugcaauggcggcagaaguaacacgaagaggaagcgcauauuauauguauuuagaucgaagugaugcgggagaagcaauaagcuucccaacaacauuaggaaugaacaaauguuauauacaaauaauggauuuaggacacaugugugaugcaacgaugucauaugaauguccaauguuagaugaaggaguagaaccggaugaugucgauuguugguguaauacaacaucaacauggguaguauauggaaccugccaucauaaaaaaggugaagcaagaagaucuaggagagcaguaacgcuuccaagucauaguacaaggaaauuacaaacuagaagucaaacaugguuagaaaguagagaauacacuaaacauuuaauacgaguagaaaacuggauauuuagaaauccaggcuucgcauuagccgcagcugccauagcaugguuauuagguucgaguacgucacaaaaaguuauauauuuaguuaugauucuauuaauugcccccgcauauaguauaagaugcauaggagugaguaaccgggauuuuguugaaggaaugucaggaggaacaugggucgauguuguauuagaacaugguggaugcguaacaguuauggcacaagacaaaccaacaguggacauagaauuaguaacaacaacgguaaguaauauggcagaaguacgaaguuacuguuaugaagcaaguauaucagauauggcaagcgauucuagauguccaacucaaggcgaagcauaucuagauaaacaauccgauacacaauacgugugcaagaggacguugguagauagaggaugggguaaugggugcggguuauucggaaaagguucauuaguaaccugcgcuaaauucgcguguucuaaaaaaaugacaggaaaaucaauacaaccggaaaauuuagaguauagaauaauguugucaguucauggaagucaacauucaggaaugauaguaaaugauacuggacaugaaacagacgagaaccgagcaaaaguugaaauaacaccaaauaguccaagggcagaagcuacauuaggaggauuuggcucucuaggacuggauugugaaccaagaacuggcuuagauuuuagcgaccuauauuaccuaacgaugaauaauaagcacuggcuaguacacaaagaaugguuccacgauauaccauuaccauggcaugcaggugcagauacaggaacuccacauuggaauaauaaagaagcacuaguggaguuuaaagacgcacaugcaaaaaggcaaacaguuguaguuuuaggcagucaagaaggcgcuguacauacagcauuagcaggagcacuagaagcggaaauggauggagcaaaaggaagauuaucaagcggacaucuaaaauguagguuaaaaauggauaagcuuagauuaaaaggagucaguuacucauuauguacggcagcuuuuaccuuuagcaaaauaccagcagaaacacuacacggcacaguuacugaagaagugcaauaugcuggaacugauggcccaugcaaaguaccggcacaaauggcaguagauaugcaaacacuaacaccaguaggaagauuaauaacagcaaacccaguaauaacagaaucaacagaaaacaguaaaaugauguuagaauuagacccaccauuuggagauucauauauagucauaggaguaggagaaaaaaaaauuacccaucauuggcauagaagugguaguacaauaggcaaagcauucgaagcuacaguaagaggagcaaaaaggauggcagucuuaggagacacagcaugggauuuuggaucaguaggaggagcuuuaaauaguuuaggaaaaggaauucaucagauauucggagcagcauuuaaaagccuauucgguggaaugagcugguuuucgcaaauauugauaggaacauuacuaaugugguuaggauuaaacacaaaaaacggaucuauaagucugaugugccuagcguuagggggcguucuaauauuccucucaacagcaguaucagcggacguaggauguucaguagauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7033 - RNA, 2524 nt, Artificial Sequence
  KX694532.2 prME-long mRNA Design 2 opt
ggggcgcugccuacggagguggcagccaucuccuucucggcaucaagcuuaccaugagaauaauaaaugcacgaaaagaaaaaaaaagaagaggaacagacacuucaguaggcauuguaggacuacuacuuacaacagcaauggcagcagagguaacacgaaggggaagugcauauuauauguauuuagacagaucagaugcaggagaagcgaucucauuuccuacaacauugggaaugaauaaauguuacauccaaauaauggaucugggccauaugugugaugcaacaaugaguuacgaauguccaauguuagaugaaggggucgagccagaugauguagauuguugguguaauaccacuucaacauggguuguuuauggaacaugccaucauaaaaaaggagaagcaagaagauccagaagggcaguaacauuaccaucacauucuacacgaaaauuacaaacccgaucgcaaacauggcuagaaaguagagaauacaccaaacauuuaauaagagucgaaaauuggauauucagaaacccaggcuuugcuuuagcagcagcugcgauagccuggcuacuaggaaguagcacuucacaaaaagucaucuauuuaguaaugauuuuacuaaucgcuccagcauacagcauuagauguauuggaguuaguaauagagacuuuguagaaggaaugucaggcggaacauggguugaugugguccuagaacauggcggauguguaacaguaauggcccaagauaaacccacaguagauauagaauuaguaacgacaacagugagcaauauggcagaaguaagaucauauugcuacgaagcuucaauaucugauauggcaagcgauucgagaugcccaacacaaggagaagcauaucucgauaaacaaagcgacacucaauauguaugcaaaagaacacuaguagacagaggcugggguaaugguugugguuuguuuggaaaagggaguuuaguaacaugugcuaaauucgcaugcucgaagaaaaugacaggcaaaucaauacaaccugaaaauuuagaauacagaauaaugcuaaguguacaugguucacaacauucagguaugauuguaaaugauacaggucacgaaacagaugaaaauagagcuaaaguagaaauaacccccaauucaccaagagcugaagccacacuaggaggcuucgguaguuuaggguuagauugugaaccuagaacagggcuugauuuuucagaccuuuauuaucucacaaugaauaauaaacacuggcucguacauaaagaaugguuccaugacauaccucuacccuggcacgcuggagcagauacaggaacgccacacuggaauaauaaagaagcuuuaguagaauucaaagaugcccacgccaaaagacaaacuguaguaguacuaggaagucaagaaggagcaguacacacagcuuuagcaggagcauuagaagcggaaauggacggagcgaaaggaagauuaucaucuggucauuuaaaauguagauugaaaauggauaaacuaagauuaaaagguguuucauauagcuuaugcacagcugcauuuacauuuacaaaaauaccagcagaaacuuuacauggcacaguaacaguagaaguccaguaugcagguacugauggaccuuguaagguacccgcacaaauggcaguagauaugcaaacacucacaccaguaggaagacuaauuacagcuaauccaguuauuacagaaagcacagaaaauuccaaaaugaugcuagaguuagauccaccuuuuggugacaguuauauagugauaggggucggagaaaaaaaaauaacacaucacuggcauagaagcggaucaacaauaggaaaagcauuugaagccacaguaagaggagcuaaaagaauggcuguacuaggcgauacagcaugggauuucggaaguguuggcggagcucugaacagccucgggaaagguauacaucaaauauuuggugcggcauuuaaaaguuuauuuggaggaaugucaugguuuucacaaauauuaauaggaacacuacuaaugugguuaggucucaauacuaaaaauggaaguauaagcuuaauguguuuagcauugggaggagucuuaauauuccuaucaacagcaguaagugcagauguaggauguaguguugauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7034 - RNA, 2524 nt, Artificial Sequence
  KU955593.1 prME-long mRNA Design 2 opt
ggggcgcugccuacggagguggcagccaucuccuucucggcaucaagcuuaccaugagaaucauuaaugcacguaaagaaaagaaaagaaggggaacagauacgucuguaggaauaguuggacuacuauuaacaacugcaauggcuguagaaguaacaagaagaggaaaugccuauuauauguauuuagauaggucggacgcaggagaagcaauuucauucccaacaacaaugggaaugaacaaauguuauauccaaaucauggaccuuggacauaugugugacgcaacaaugucauaugaauguccaauguuagaugaagggguugaaccagaugauguagauuguuggugcaacacaacaagcacauggguagucuacggaacaugucaucauaagaaaggagaagcacgaagaucaagacgagcaguuacauuaccaagucacucaacaagaaaauuacaaacaagaucacaaacauggcucgaaaguagagaauacaccaaacaucugauccgaguagaaaacuggauauuuagaaaucccgguuuugcucuugcugccgccgcaaucgcaugguuacuaggaucgucuacuucacaaaaaguuauauauuuaguaaugauauuauugauagcuccagcauauuccauuagaugcauaggaguuuccaauagagauuuuguagaagggaugagcggagguaccuggguagauguaguauuagaacacggaggaugcguuacaguaauggcacaagacaaaccaacaguagacauagaauuaguuacaacaacaguaucaaacauggcagaaguucguuccuauugcuacgaagcaaguauuucagauauggcaagugauaguagauguccgacacaaggagaagcauauuuagacaaacaaucagacacucaauauguauguaaaagaacucuaguagauagagguuggggaaauggcuguggauuauucggcaaaggaucucuaguaacaugugcaaaauuugccuguaguaagaaaaugacaggaaaauccauccaaccagaaaauuuagaauaucgaauaauguuaucaguacauggaucacaacauuccggaaugaucgucaacgauacuggucaugagacugaugaaaauagagcaaaaguagaaauaacaccaaauucaccucgagcugaagcaacauugggaggauuuggaucacuaggacuagacugugaaccaagaacaggacuugauuuuagcgacuuauauuaccuuacgaugaacaauaaacauugguuaguacauaaagaaugguuucacgacauaccacuaccuuggcaugcaggagcagauacgggaacuccccauuggaacaauaaagaggcuuuaguagaguucaaagacgcacacgcaaaaagacaaacaguaguaguucuuggaagucaagaaggagcuguacacacagccuuagcuggugcacuagaagcagaaauggauggagcaaaaggaagauuaaguaguggacacuuaaaauguagauuaaaaauggauaaauuacgauuaaaaggaguuucauauucauuaugcacagcagcuuuuacguucacgaagauaccagcagaaacacugcacggaacaguaacaguagaaguacaauaugccgguacagauggaccuuguaagguaccagcacaaauggcuguugacaugcaaacauuaacucccguugguagacuaauaacagcaaauccaguaauaacugaaagcacagaaaauucuaaaaugaugcuagaauuagauccaccuuuuggagauagcuacaucguaauaggaguuggcgaaaagaaaauaacucaucacuggcaccguucagggucaaccauugguaaagcauuugaagcaacaguaagaggagccaaaagaauggcgguacuaggagauacggcaugggauuuuggaaguguaggaggugcccuaaauuccuuggguaaaggaauacaccaaaucuuuggagccgcauuuaaaucauuauucgggggaaugaguugguucagccaaauauuaauuggaacacuauuaguaugguuaggauugaauacuaaaaauggaucuauaucacuaaugugccuagcauuaggaggagugcucauauuccuaaguacugcuguuucagcagauguaggauguaguguagauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7035 - RNA, 2524 nt, Artificial Sequence
  KY272987.1 prME-long mRNA Design 2 opt
ggggcgcugccuacggagguggcagccaucuccuucucggcaucaagcuuaccaugagaauaauaaaugcaagaaaagaaaaaaaacgaagaggaacagauacaagcguggguauaguuggcuugcuauugacuacugcaauggcagcugaaguaaccagaagaggaagugcauacuacauguaucuagaucguucugaugccggugaagcaaucucauuuccuacaacauuagguaugaacaaauguuauauacaaauaauggaucuaggucauaugugugaugcaacaaugucuuaugaauguccuaugcuggacgagggaguugaaccagaugacgucgauugcuggugcaauaccacguccacauggguaguuuauggaacuugucaccacaaaaaaggagaagcaagaagaaguagaagagcaguaacgcuaccaagucauaguacaagaaaacuccaaacaaggucacagacuuggcucgaaaguagggaauauacuaaacaucuaauacgaguagaaaauuggauauuuagaaauccaggguuugcguuagcagcagcagcaauagcuugguuauuaggcuccaguacuucacaaaaaguaaucuacuuaguaaugauauuauuaauagccccagcauauucaauaagauguauagguguuaguaauagagauuuuguagaaggaaugucaggagguacuuggguagaugucguucuagaacacggaggaugcguaacaguaauggcacaagauaaacccacuguagauauagaacuaguuacaacaacuguauccaauauggcagaaguaagaaguuauuguuacgaagcuagcauaagcgauauggcaagugacucaagaugucccacacaaggugaagcauaccuugauaaacaaucagauacucaauauguaugcaaacguacacugguagaccguggaugggggaauggaugcggacuauucgguaaaggauccuuaguuacaugugcaaaauuugcuuguucaaaaaaaaugacugggaaaucaauacaaccagaaaacuuagaauauagaauuauguuaucgguacacggaucacagcauucuggaaugauaguaaaugauacaggacaugaaacagaugaaaaucgagcuaaaguagaaauaacuccuaauaguccaagagcggaagcaacucuaggagguuuuggaagucuaggauuagauugcgaaccgagaacuggguuagacuuuucagauuuauauuaucuaacuaugaacaacaagcacugguuaguacauaaagagugguuucaugauauaccgcuaccauggcaugcgggagcugauacaggaacuccacauuggaauaauaaagaagcacuaguggaauuuaaagaugcacaugcaaaacgacaaaccgugguaguacuaggaucacaagaaggagcaguacauacagccuuagcuggugcauuagaagcagaaauggauggagcaaaaggaagauuaaguaguggucaucuaaaauguagacuaaagauggacaaauuaagauuaaagggagugucuuacagucuauguacagcagccuuuacauuuacaaaaauaccugcugaaacauuacacggaacaguaacuguggaaguacaauaugcagguaccgauggaccauguaaaguuccugcacaaauggcuguagauaugcaaacucucacaccgguaggacgacuaauaacagcaaauccaguaaucacagaaaguacugaaaauaguaaaaugaugcucgaguuagauccacccuuuggcgacagcuauauaguaaucggaguaggugaaaaaaaaauuacacaccacuggcacaggaguggaagcacaauaggaaaagcuuucgaagcaacaguuagaggugcaaaaagaauggcuguacugggagauacagcaugggacuuuggaaguguaggaggagcacuaaauagcuuaggaaaaggaauacaccaaauauuuggagcagcauuuaaaucacuauuuggagguaugaguugguuuucgcaaauuuuaauaggaacauuauuaaugugguuagggcuaaauacaaaaaauggaaguauaucauuaguuugucuagcgcucggaggaguacuuauauuuuuaagcacagcaguaucagcagacguuggauguaguguggauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7036 - RNA, 2524 nt, Artificial Sequence
  EU545988.1 prME-long mRNA Design 2 opt
ggggcgcugccuacggagguggcagccaucuccuucucggcaucaagcuuaccaugagaauaauaaaugcaagaaaagaaaaaaaaagaagaggaacagacacaaguguuggaauuguugguuuacuacuuacgacagcuauggcaguagagguuacaaggagagguagugcauauuauauguaccuagauagaucagaugcaggagaagccauaucauuuccgaccacuuuaggaaugaauaaauguuauauacaaauaauggaucuaggacauaugugugaugcaacaaugaguuacgaaugcccaauguuagaugaaggaguagaaccugaugauguagauugcugguguaacacuaccucaacauggguuguauacggaacaugucaucauaaaaaaggugaagcuagacgaagcagacgagcuguaacguuaccaagucauucaacacgaaaacuacaaacuagaucacagacauggcuugaaucaagagaauauacaaaacacuuaauuagaguugaaaauuggauauuuagaaauccaggauuugcacucgcagcagcagcaauugcauggcuccuuggcaguaguacaucacaaaaaguaauauauuuaguuaugauauuauuaauagcuccagcauacaguauucgaugcauaggaguuucaaacagagacuuuguagaaggaaugucaggaggcacauggguagacguaguacuagaacacggcggauguguuacaguuauggcccaagauaaaccagccguagauauugaauuaguuacuacgacaguaaguaauauggcagaagugagaucauauuguuaugaagcaaguauaucagauauggcgucagauagccguugccccacccaaggcgaagcuuaucuagacaaacaaagugacacacaguacguauguaaaagaacauuaguagacaggggauggggaaauggaugcggacuauuuggcaaaggaagcuuaguaacaugcgcaaaauucgcuuguagcaaaaaaaugacaggaaaaucaauacaaccagaaaacuuagaauauagaauuauguugucaguacacgggagucaacauuccggaaugauaguaaaugacacuggucacgaaacagacgaaaauagagcaaaaguagaaauaacgccaaauucuccuagagcagaagcaacacuaggaggauuugggucuuuaggguuagacugugagccaagaacaggauuagauuuuucugauuuauauuauuuaacaaugaauaacaaacauugguuaguacauaaagagugguuccaugacauaccucuaccauggcaugcaggagcagauacuggaacuccacacuggaauaacaaagaagcacuuguugaauuuaaagacgcucaugcaaaaagacaaaccguaguuguauuaggaucacaagaaggugcggugcacacagcuuuagcaggggcccuagaagccgagauggauggugcaaaagguagacuuagcucuggucaccuuaaaugccgacuaaaaauggauaaauuaagacuaaagggaguaaguuauagccuauguaccgcagcguuuacauuuacaaaaauaccagcagaaacacuacauggaaccgugacaguagaaguucaauacgcaggaacagaugguccauguaaaguaccagcacaaauggcaguagauaugcaaacauuaacaccagugggaagauuaauaacagcaaacccaguaauaacagaaaguacagaaaauucaaaaaugauguuagaauuagaccccccuuuuggagauagcuauauagucauagguguuggcgaaaaaaaaauaacacaucauuggcauagaagcgguucaacaauaggaaaggcauuugaagcaacgguacgaggugcgaaaaggauggcuguauuaggagauacggcaugggauuuuggaucaguaggaggagcguuaaauucauuaggcaaaggaauacaucaaauauucggagcugcguuuaaaucauuauuuggugguaugucaugguucagucaaauauuaauaggaacacuuuuagucuggcuagguuuaaacaccaaaaaugguagcauaucauuaacaugcuuagcauuaggaggaguauuaauauuccucagcacagcgguuucagcagacguaggauguaguguagauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7037 - RNA, 2524 nt, Artificial Sequence
  KU681082.3 prME-long mRNA Design 2 opt
ggggcgcugccuacggagguggcagccaucuccuucucggcaucaagcuuaccaugagaauaauaaaugccagaaaagaaaaaaaaagaagaggagcggacacuucaguagguauaguaggacuauuauuaacaacagcgauggccguagaaguaacaagaagaggaagugcauauuauauguacuuagauagaagcgacgcaggagaagcgaucaguuucccaacaacauuagguaugaauaaauguuauauacaaauaauggaucuuggacauaugugugacgcaacuaugucauacgaauguccaaugcuagacgaaggaguagaaccugaugacgucgauuguugguguaauacaacuagcacauggguaguauauggaacaugucaucauaaaaagggugaagcuagaagaaguagaagagcaguaacgcuuccaucacacaguacaagaaaauuacaaacuagaagucaaacauggcuagaaucuagagaauauacuaaacaucucauacgaguagaaaacuggauauuucguaauccgggauuugcauuggcugcggcuguaauagccugguuauuaggaaguaguacaagucaaaaagugauauauuuaguaaugauacuacuuauugcuccagcuuacaguauaagaugcaucggaguaucaaauagagauuucgucgaaggaaugaguggagggacauggguagacguaguacuagaacauggaggcugcguaaccguaauggcacaagauaaaccaacaguagauauagaauuaguaacaacgacaguuuccaauauggcugaaguacgaucauacuguuaugaagccagcauuagugacauggcaucugauucuaggugucccacucaaggugaggcauaucuagacaaacaaucagauacacaauauguauguaaaagaacauuaguagauagaggaugggggaauggaugugggcuauuuggaaaaggaucguuagucacaugcgcgaaauuugcuuguucaaaaaaaaugacaggcaaaucaauucaaccugagaauuuagaauauagaaucauguuaucaguucauggaucacaacacagcggaaugauaguaaaugauacgggacaugaaacugacgaaaauagagcaaaaguugaaauaacuccaaauuccccuagagcagaagcaacacuagguggauuuggaucauuaggacuagauugcgaaccaagaacaggauuagauuuuagcgaucuauacuauuuaacaaugaauaacaaacauugguuaguacauaaagaaugguuucaugauauaccauuaccauggcaugcaggggcagacacugguacaccgcauuggaauaauaaagaagccuuaguagaauuuaaagacgcacaugcaaaaagacaaacaguugucguauuagguucucaagaaggagcaguacauacggcuuuagcaggagcucucgaagcugagauggacggagcaaaaggcagacuuucaaguggacaucucaaauguagguuaaagauggauaaacuucgauuaaaaggaguaaguuacucccuauguacugcagcauuuacuuuuacaaaaauaccagcugaaacuuugcauggaacaguaacaguagaaguacaauacgcaggaacggacggaccaugcaaaguuccagcacaaauggcaguagauaugcaaacacugacgccaguaggaagguuaauuacagcgaacccaguaauuacagaaucuaccgaaaauucaaaaaugauguuagaauuagaccccccuuuuggagacucuuacauaguuaucggaguaggugaaaaaaaaauaacacaccauuggcaucguagugguuccacaauaggaaaagcuuucgaagcaacuguaaggggagcaaaaagaauggcaguuuuaggagacacggcaugggacuucggaaguguaggaggggcacugaauucucuaggaaaaggcauacaucaaauauuuggugccgcauuuaaaucauuauuuggaggcaugaguugguuuucucaaauauuaauugguacauuauuaguauggcuaggauugaauaccaaaaacggauccauaucacuaacaugucuagcacuuggaggaguucuaaucuuucuaucaacagcuguaucagcagauguaggcuguucuguagauuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7038 - RNA, 2524 nt, Artificial Sequence
  KX601167.1 prME-long mRNA Design 2 opt
ggggcgcugccuacggagguggcagccaucuccuucucggcaucaagcuuaccaugagaauuauuaaugcaagaaaagagaaaaaaagaagaggagcagauacaaguguuggaauaguaggauuacuacuaacaacagcaauggcaguggaaguaacacgcagaggaucugcauauuauauguaucuagauagaagugaugcuggagaagcaauaaguuuuccgacaacucuaggaguaaacaaauguuauauucaaauaauggaucuaggacacaugugcgaugcaacuaugucauacgaguguccuauguuagaugaaggugucgaaccugaugauguagacuguugguguaauacaacauccacguggguagucuauggcacaugucaucauaaaaaaggagaagcuagacgaucaagaagagcaguuacucuaccaagccacucgacaagaaaacuacaaacaagaucacaaacauggcuugaaucaagagaauauacaaaacaucuaauaagagucgaaaauuggauauucagaaauccaggauuugcauuagcagccgcagcaauagcaugguuauuaggcucaaguacaagccaaaaaguaauauaucuaguaaugauacucuuaauagcaccagcauacucuauaagaugcauugguguuaguaacagagacuuugucgaaggaaugucgggaggaacuuggguagauguaguacuagaacaugguggauguguaacaguaauggcacaagauaaaccaacaguagauauagaauuaguuacaacaacgguaucaaauauggcagaaguuagaagcuacuguuaugaagcaaguauuucagacauggcaucagacucaagauguccuacacaaggagaagcauaucuugauaaacaaagcgauacacaguacguauguaaaagaacacuaguugauagaggaugggguaauggauguggucuauuuggaaaaggaaguuuaguaacuugugcaaaauuugcauguucuaaaaaaaugacaggaaaaucaauucaaccugaaaacuuagaauauagaauaauguuaucuguacauggaucccaacauucaggaaugauuguaaaugauacaggucaugaaacagaugaaaauagagcuaaaguagaaaucacuccgaacucaccacgagcagaagcuacuuuaggaggauucgggucauuaggccuugauugcgaaccaaggaccggacuagauuuuucagauuuauacuacuuaacuaugaauaauaaacacugguuaguacacaaggaaugguuucaugacauacccuuaccauggcaugcaggagccgacacaggaacuccacauuggaauaauaaagaagcacuaguagaauucaaagaugcucaugccaaaagacaaacaguaguaguuuuaggaagccaagaaggcgcuguccauacagccuuagcaggagcacucgaagcagaaauggauggagccaaaggaagacuaucaucaggucauuuaaaaugucgucuuaaaauggauaaauuaagacuuaaagguguuaguuauagcuuauguacagcggcauuuaccuuuacaaaaauaccugccgaaacacuucacggaacaguuacaguugaaguacaauaugcagggacagacggaccaugcaaaguuccugcacaaauggcaguugauaugcaaacauuaacaccaguaggcagauuaauaacagcaaacccaguuauaacugaaucaaccgaaaacaguaaaaugauguuagaauuagauccaccuuuuggcgacaguuauauaguaauaggaguaggugacaaaaaaauaacucaucacugguacagaaguggaucaacuauagggaaagcauuugaagcaacaguaagaggggcaaaaagaauggccguauugggagauacggcaugggacuuuggcucaguaggcggugcuuugaauaguuuaggaaaagguauacaucaaauauuuggagcagcauuuaaaucauuguuuggaggaaugaguugguuuucucaaauuuugauugguacauuauuagugugguuaggacuaaauaccaaaaacggaaguaucagccuaacuugcuuagcccuaggggggguacuaauauuuuuaaguacagcagugagugcggacguaggaugcagugucgacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7039 - RNA, 2524 nt, Artificial Sequence
  KX694533.2 prME-long mRNA Design 2 opt
ggggcgcugccuacggagguggcagccaucuccuucucggcaucaagcuuaccaugaggauaaucaaugcaagaaaagaaaaaaaaagaagaggugcugacacauccgucggaauaguaggacuguuacuaaccaccgcgauggcuguagaaguaacacgacgcggcagcgcauauuauauguacuuagauagaagugaugcagguaaagcaaucuccuuuccaacaacauuaggaguaaauaaauguuacauacaaauaauggauuuaggacauaugugugaugcaacaaugucauaugaauguccuaugcuggaugaaggaguagaaccugaugacguugauuguuggugcaauaccacuucaacaugggucguauauggaacaugucaucauaaaaaaggagaagcuagaagaagcagaagagcgguuacucuuccaagucauaguacuagaaaacuacaaacaagaucucaaacuuggcuugaaucaagggaauacaccaaacauuuaauaagaguagaaaauuggaucuucagaaauccaggauucgcacuagcagcagcggcaauagcauggcuacuugguucaucuacaagccaaaaaguaauauauuuagucaugauacuauuaauagcacccgcauauucuaucagaugcauaggaguaaguaauagagauuuuguagagggaauguccggaggaacauggguagauguaguccucgaacaugguggauguguuacagugauggcacaagacaagccaacaguagauauagaauuaguuacgacaacugucucaaauauggcagaaguaagaagcuauuguuaugaagcaagcauaucugauauggcaagcgauucaagauguccuacucaaggagaagcguauuuagauaaacagucagacacacaguacguauguaaacgaacacuaguagacagaggauggggaaacggauguggauuauucggaaaagguaguuuaguaaccugugcaaaauuugcguguucaaaaaaaaugacuggaaaaaguauacaaccagaaaauuuagaauauaggauaaugcucagcgugcauggaucacaacauucaggaaugauaguaaacgauauaggacaugaaacagacgaaaaucgagcaaaagucgagauaacacccaauucaccacgagcagaggcuacccuuggagguuucggaucauuaggauuggauugcgaaccacgaacaggacucgauuuuagugauuuauauuaucuuacaaugaacaacaaacauugguuaguacauaaagaaugguuucaugacauuccacuaccauggcaugcaggagcagauacugguacaccacacuggaacaauaaagaagcacuaguagaauuuaaagaugcucacgcuaaaagacaaacaguagugguauuaggaagucaagaaggagcaguacauacagcacuagcaggagcccuggaagccgaaauggauggagcaaaaggaaggcuaucaucaggccaucuaaaaugcagacuaaaaauggauaaauugagauuaaaaggaguaucguauagcuuaugcacagcagcguuuacuuuuacaaaaauaccagcugaaacacuacacggaaccguaacuguagagguacaauacgcaggaacagaugguccauguaaagucccagcacaaauggcaguagauaugcaaacauuaacacccguaggaaggcuuauaacugcaaauccaguuauaacagaaaguacagaaaauucuaaaaugaugcuggaauuagauccacccuucggagauucauacauaguaauaggaguaggagauaaaaaaauuacacaucauuggcauagaucugggaguacaauugguaaagccuuugaagcaacagugcgaggcgcaaaaagaauggcaguauuaggagauacagcuugggauuuuggaucagugggaggagcauuaaauaguuuaggaaaaggaauacaucaaauauucggagcagcauuuaaaagucuauuuggaggcaugucaugguuuucacaaauucuuauaggaacgcuuuuaguaugguuaggauuaaauacaaaaaauggaucaauaucacugacauguuuagcgcuagguggcguuuuaauauuuuuaagcacggcaguaucagcagacguaggaugcucaguagauuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7040 - RNA, 2524 nt, Artificial Sequence
  KY288905.1 prME-long mRNA Design 2 opt
ggggcgcugccuacggagguggcagccaucuccuucucggcaucaagcuuaccaugagaauaauaaaugcaagaaaagaaagaaaaagaagaggagcagauacaagcauagguauaguagggcuauuauuaacaacugcuauggcagcagaaaucacgagaagaggaagugcauauuacauguauuuggacagaucugaugcaggaaaagcaauaucuuucgcaacaacuuuaggcguaaacaaaugucauguucaaauaauggacuuaggccacaugugugaugcgacaaugaguuaugaauguccaauguuagaugaaggaguagagccagaugauguugauuguuggugcaauacaacaagcacaugggucguuuacgggacuugucaucauaagaaaggagaagcaagaagaaguagacgagcuguuacuuuaccaagccauaguacaagaaaauugcagacaagaagccaaacauggcucgaaagcagagaauauacaaaacauuuaauaaaaguagaaaauuggauauuccgaaacccaggauuuacgcugguagcaguagccauagcuugguuguuaggauccuccacgucacaaaaagugauauacuuagugaugauauuacuaauugcaccagcuuauucaauaagguguauaggaguaucaaauagagauuuuguagaaggaaugaguggaggaacuuggguagacguaguacuagaacauggagguugugugacuguaauggcacaagauaaaccgacuguugauauagaacuuguaacaacaacuguaucaaauauggcugaaguaagaucauacugcuaugaagcaucuauaagugauauggccuccgauucaaggugcccaacacaaggggaggcuuacuuagauaaacaaagugauacacaauauguauguaaacgaacauuaguagauagaggaugggguaaugguugcggauuauuuggaaaaggaaguuugguaacaugugcuaaauuuacuugcaguaagaaaaugacaggcaaaagcauacaaccggaaaaucuggaauauagaauaauguuaucaguacauggaucacaacauaguggaaugauaguaaaugacacugggcaugaaacagaugaaaauagagcaaaaguagaaguuacaccgaacagcccaagagcggaagcaacuuuagguggguucggaucccuaggacuagacugugaaccaagaacaggcuuggauuuuagugacuuauauuaccuaacaaugaacaauaaacauuggcuaguucauaaagaaugguuucacgauauaccauuaccauggcacgcaggagcagauacaggaacaccacauuggaauaauaaagaagcgcuagucgaguucaaagaugcacacgcaaaacgacaaacaguagucguacuugguucacaagaaggagcaguucacacugcuuuagcgggugcauuagaagcagaaauggauggagcaaaaggaagacuauuuucaggacaucuuaaaugccgucuuaaaauggauaaauuaagacuuaaaggaguaaguuauucacuaugcacagcagcauucacauuuacuaaaguuccugcagaaacauuacacggaacagugacaguugaaguccaauacgcuggaacagaugguccauguaaggucccagcacaaauggcgguagauaugcaaacauugacaccaguuggaagacuaauuacagcaaauccaguaauaacagaaaguacagaaaauaguaaaaugauguuagaauuggacccacccuuuggagauaguuauauaguuauaggaguaggagauaagaaaauaacacaucacuggcauagaucuggaucaacgauaggaaaagcauuugaagcaacuguaagaggagcuaaaagaauggcaguacuuggagauacagcaugggacuucggcucaguaggcggugucuucaauucauuaggaaaaggaauacaucaaauauuuggcgcagcauuuaaaucacuauucggagguaugaguugguuuucacaaauacuuauaggaacccuuuuaguuuggcuaggacuaaauacuaaaaaugguucaaucaguuuaacauguuuggcauuaggaggaguuaugaucuuucuaagcacagcuguuagugcugauguaggguguagcguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7041 - RNA, 2524 nt, Artificial Sequence
  KF268950.1 prME-long mRNA Design 2 opt
ggggcgcugccuacggagguggcagccaucuccuucucggcaucaagcuuaccaugagaauuauaaaugcaagaaaagagagaaagagacgaggagccgacacaucuauaggaauaauaggacuacuauuaacaaccgcaauggcagcagaaauaacucgaagagggagugcauacuacauguauuuagaucgaucagacgcugguaaagccauaaguuuugcgacuaauuuaggaguaaacaaaugccauguucaaauuauggaccuaggacauaugugcgaugcaacaaugaguuacgaauguccaaugcuagaugaaggaguagaaccagacgauguagauugcugguguaauacaacaucaacauggguuguauacggaacaugucaucauaaaaaaggagaagcaagacgaucaagaagagcaguaacuuugcccucucacagcacaagaaaauuacagacccgaagccaaaccuggcuagaaucaagagaauauacaaaacaucuuauaaaaguugaaaauuggauauuuagaaaucccgguuuugcguuagcagcaguagcuauagccugguuacuuggaagcaguacaucacaaaaaguuauauauuuaguuaugauauuauuaauugcgccagcuuauucaauuagauguaucggaguaagcaaccgggauuucguugagggaaugucaggggguacauggguagauguaguauuagaacaugggggaugcguaacaguaauggcgcaagauaaaccaacaguagacauagaauuaguaacaacgaccgugucaaacauggcagaaguucgcucauauuguuaugaagcaaguauaucugauauggcaucagacucaagauguccuacacaaggugaagcauacuuagacaaacaaucugauacucaguacgucuguaaacgaacucuaguagacagaggauggggaaauggaugcggucuauuugguaaaggaucacuagugacuugugcaaaauuuacauguagcaaaaaaaugacagguaaaaguauucagcccgaaaaccuugaguauagaauaauguuaucaguccauggaucucaacauagugguaugauagucaaugauauaggccaugaaacagaugaaaauagagcaaaaguugaaguaacaccaaauucaccaagagcagaagcaacccuagggggauuuggaucacuuggauuagauugugaaccuagaacuggacuagacuuuucagacuuauacuauuuaacaaugaacaauaaacauugguugguacauaaagaaugguuucacgauaucccuuuacccuggcaugccggagccgauacaggaaccccacauuggaauaauaaagaggcacuaguugaauuuaaggaugcacaugcgaaaagacaaacaguaguaguacuaggaucacaagagggagccguacauacggccuuagcuggagcacuagaagcagaaauggacggagcuaaaggaagacuauuuagcgggcacuugaaaugccgauuaaaaauggauaaauuacgacuuaaaggaguuuccuacucauuaugcacagcugcauuuacguuuacuaaaguaccugcagaaacauugcacggaacaguaacaguagaaguacaauaugcugguacagauggacccuguaaagugccagcgcaaauggcuguggauaugcaaacauuaacuccuguuggaagacuaauaacagcaaauccaguaauaacagaaucaacugaaaacaguaaaaugauguuagaauuagacccuccauuuggggauucguauauaguaauagguguuggagauaaaaaaauaacacaucauuggcauagaagugggucgacaauaggaaaagcuuucgaagcaacaguaagaggagcaaaaagaauggcagucuuaggagacacagcaugggauuuuggaucaguuggaggugucuucaauaguuuagguaaaggaguacaccaaaucuucggagcagcuuucaaaagucuauuugggggaaugucaugguuuucacaaauacuuauuggaacauuacuagucugguuaggacucaauacaaaaaauggcaguauaagcuuaacauguuuggcauuaggaggcgugaugauuuuccuaagcacagcaguaucagcagacguagguuguaguguugauuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7042 - RNA, 2524 nt, Artificial Sequence
  KF383121.1 prME-long mRNA Design 2 opt
ggggcgcugccuacggagguggcagccaucuccuucucggcaucaagcuuaccaugcgaauaauaaacgcaagaaaagaacgaaaaagaagaggagcagacacaucaauuggaauaauaggucuguuauuaacaacagccauggccgcagaaauuacaagaagaggcagugcauauuauauguauuuagaccgaagugaugcuggaaaagcaauaucauucgcuacuacauugggagucaauaaaugucauguccaaauuauggaccuuggucauaugugcgacgcaacuaugucauaugaauguccgauguuagaugaggguguugaaccagacgacguagauuguuggugcaacacaacaaguacuuggguaguauauggaacaugccaucauaaaaaaggagaggcacgccgaaguagaagagcaguaacacuaccaucucacucaacaagaaaauuacaaacuaggucacaaacaugguuagagucacgcgaauacacaaaacauuuaauaaaaguagaaaauuggauauuuagaaauccaggauuugcacuuguagccguagccauagcuuggcuacuugguagcucaacaagucaaaaaguaauauauuuaguaaugauauuacuaauagccccagcauacaguauaaggugcauagguguaucaaauagagauuuuguagaagguaugucaggcggaacauggguagauguaguacuugaacacggaggaugcguaacaguaauggcgcaagacaaacccacaguagacauugaacuaguaacaaccacaguaagcaauauggcugaaguaagaucuuauuguuacgaagcaaguauaagcgauauggcaagugauucaagauguccuacacaaggcgaagcauauuuggauaagcaaagugacacucaauauguuuguaaaagaacuuuagucgacagaggauggggaaauggaugcggacuuuuuggaaaaggaagccuaguaacaugcgccaaauucacauguaguaaaaaaaugacaggaaaaaguauacaaccugaaaaccuagaguacagaauaaugcuuaguguacacggaagccaacacuccggaaugauuguaaaugauauuggucaugaaacagacgaaaauagagcaaaaguagaaguuaccccaaacucaccuagagcagaggcaacacuagguggauuuggcucauuaggauuagauugugaacccagaacagggcuagacuuuagugacuuauauuaucuaacgaugaacaauaaacauugguuaguccauaaagagugguuccaugauauaccccuaccauggcaugcgggagcagauacugguacaccacauuggaacaacaaagaagcauuaguagaauuuaaagacgcucaugcuaaaagacaaacuguaguaguauuaggaucacaagaaggugcagugcacacagcauuagcaggugcucuagaagcagaaauggauggagcaaaaggaagauuauucucagggcaucuaaaaugccgauuaaaaauggauaaauuaagauuaaaagggguaaguuauucauuauguacagcagcauucacuuuuacuaaaguaccagcagaaacauuacacgguacagucacaguagaaguacaauaugcaggaacagauggaccaugcaaaguaccagcacagauggcaguagauaugcaaacauuaacaccaguuggacguuuaauaacagcgaauccaguaauaacagaaucaacagaaaauaguaaaaugaugcuagaguuggauccgccauuuggggauucuuacauaguuauaggagugggugacaaaaaaauaacucaccauuggcacagaagcgguucaacaauaggaaaagcauuugaagcaacaguaagaggagccaaacgaauggcaguacucggagauacagcaugggauuuuggaucagucggagguguauuuaacucauuaggaaaagguauacaucagauauucggggccgcuuuuaaaucauuauuuggcggaaugucaugguucagucaaauauuaauuggcacuuuauugguuuggcuaggacuuaauacaaaaaaugggaguauaagccuuaccuguuuagcguuaggaggaguuaugauauuuuugucaaccgcaguaagugcggauguaggaugcaguguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7043 - RNA, 2506 nt, Artificial Sequence
  KF268949.1 prME-long mRNA Design 2 opt
ggggcgcugccuacggagguggcagccaucuccuucucggcaucaagcuuaccaugaggauuauaaacgcaaggaaagagagaaaaagacguggagccgauacaagcaucggaauaauaggccuauuacuaacaacagccauggcagcugagauuacaagaagaggaagcgcauauuacauguauuuagauagaagugaugcuggaaaagcaauaucauuugcaacaaauuuaggaguaaauaaaugucauguccaaauaauggacuuagggcacaugugcgaugcaacaaugagcuaugaauguccaauguuagaugaaggagucgaaccagaugacguagauuguugguguaauacaacaucaacauggguaguauacgguacuugccaucauaagaaaggagaagcgagaagaucaagacgagccgugacucucccgagucacaguacacguaaauuacaaacucgaucacaaacaugguuagaaucucgagaauauacaaaacauuuaaucaaaguagaaaacuggauauucagaaauccaggauucgcacuagccgcaguagcaauagcaugguuauuagggaguaguacuucucaaaaaguaaucuaucucguaaugauccuauuaauugcaccagcauauagcauacguugcauaggaguaagcaacagggauuuuguggaagguaugaguggaggaacauggguagauguaguauuagaacacggagguugcguaacuguaauggcccaagacaaaccaacaguagauauagaacucguaacaacaacaguaucaaauauggcagaaguaagaaguuauuguuaugaagccaguauuucagauauggcaucagacuccagaugcccgacacaaggggaagccuauuuagacaagcaaagugauacacaauauguauguaaacgaacauuaguugauaggggaugggguaauggauguggauuauucggaaaaggaucauuaguaacaugugcaaaauucacuuguuccaagaaaaugaccggaaaaucaauacaacccgaaaacuuagaauacagaauaaugcuaucuguacauggaucacaacacaguggaaugauaguaaaugacgaaaauagggcaaaaguagaagucacaccaaacagcccucgagcggaagcaacauuaggaggauuuggaagucuaggauuagacugugaaccaaggacuggucuagauuuuucggaccuauauuauuuaaccaugaauaacaaacauugguuaguacauaaagaaugguuucaugauauuccauuaccguggcaugcuggugcagauacaggaacaccgcauuggaacaauaaagaagcauuaguagaauuuaaagaugcacaugcaaaaagacaaacaguaguaguuuugggcagccaagaaggugcaguucauacugcacuggcuggagcucucgaagcagaaauggauggagccaaaggaaggcuauuuucaggacacuugaaauguaggcuaaaaauggauaaacuaagauuaaaaggcguaucauauucucuauguacagcggccuuuaccuuuacaaaaguuccagcagaaacucuacauggcacaguuaccguagaaguacaauaugcaggcacagauggaccaugcaaaguaccagcacaaauggcaguagacaugcaaacauuaacacccguagggagauuaauaacagcaaauccaguuauaacugaaucaacugaaaacagcaaaaugauguuggaacuagauccaccuuucggcgauaguuacauaguaauagguguaggagauaagaaaauaacacaucacuggcaucguaguggaagcacaauaggaaaagcauuugaagcaacaguaagaggggcuaaaagaauggcaguacuaggagauacagcuugggacuucggaucaguaggggguguauuuaauagcuuaggaaaaggcauacaccaaauauuuggagcagcauuuaaaaguuuauuugggggaaugaguugguucucacaaauauuaauaggaacuuuauugguuugguuaggucucaacacuaaaaacgguaguauaucauuaacaugucuagcacuaggaggaguaaugaucuuuuuaucaacagcaguaucagcagacguagguuguaguguagauuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7044 - RNA, 2524 nt, Artificial Sequence
  KU955595.1 prME-long mRNA Design 2 opt
ggggcgcugccuacggagguggcagccaucuccuucucggcaucaagcuuaccaugcgaauaauuaaugcaagaaaagaaagaaaacguaggggagcagacacaucaauuggcauugucggauuauuauuaacaacugcuauggcagcagaaaucacaagaagagguagugcuuauuauauguauuuagauaggagugaugcaggaaaagcaauaucauuugcaaccacacuaggcguaaauaaaugucaugugcagauaauggauuuaggacauaugugcgaugcuacuaugaguuaugaauguccaauguuagaugaaggaguagaacccgaugauguagacuguugguguaacacaacgaguacaugggugguauauggaacaugucaucauaagaaaggagaagcaagaaggaguagaagggccguuacacuaccuagucauaguacaagaaaauuacaaacaagaagccaaacaugguuggaaagccgcgaauacacaaaacauuuaauaaaaguagaaaauuggauuuucagaaauccgggcuuugcccuaguagcaguagcaauugcaugguuacuaggaaguuccacaagucaaaaaguaauuuauuuaguaaugauauuacuaauagcgccagcauacucuauaagguguauuggaguaaguaauagagauuuuguagaaggcaugaguggaggaacuuggguagauguaguacuagaacauggaggaugugucacagugauggcccaagacaaacccacaguagauauagagcuaguaacaacuaccguaaguaacauggcggaaguaagaucauacuguuaugaagcaaguauaucagacauggcuuccgauaguagauguccgacacaaggagaagcguaccuggauaaacaaagcgacacacaauauguauguaaaagaaccuuaguagauagaggauggggaaaugguugugguuuauuuggaaaggguagcuuaguaacaugugcaaaauuuacauguucaaagaaaaugacgggaaaaucaauacaaccugaaaacuuggaauauagaauaaugcuaaguguacauggaucacaacauaguggaaugauaguaaaugauacaggacaugaaacggaugaaaaucgagcaaaaguggaaguaacgccaaacucaccaagagcggaagcgacauuaggagguuucggaucauuaggguuggacugugaaccacgaacaggacuagauuucagugauuuauacuauuuaacuaugaauaacaaacauugguuaguucauaaagaaugguuucaugauauaccauuaccauggcacgcaggcgcagauacgggaacaccacauuggaacaauaaagaagccuuagucgaauuuaaagaugcacacgcgaaacgccaaacuguaguaguuuuaggaucacaagaaggagcaguacauacagcauuagcuggugcauuggaagcggaaauggauggagcaaaaggaagauuauuuagcggucauuuaaaaugucgacuaaaaauggauaaauuaagauuaaagggaguaucauauucacuauguacagcagcauuuacuuuuaccaaaguuccagcugaaacauuacauggaacgguaacuguagaaguacaauaugcaggaacugauggaccuuguaaaguaccugcucagauggcaguugauaugcaaacauuaacaccuguaggacgauugauaaccgcaaauccagugauaacagaaucuacagaaaauaguaaaaugauguuggaauuagauccaccuuuuggugacaguuauauuguaauaggaguaggugauaagaaaauuacacaccacuggcacaggagugguaguacuauaggaaaagccuuugaagcuacaguaagaggagcaaaaagaauggcuguguuaggagauacagcuugggacuuugguucaguuggcggaguuuuuaauucguuagggaaaggcauucaucaaauauucggugcagcauucaaaagccuauucggaggaaugagcugguucagucaaauacuuauaggaacacuauuaguguggcuugguuuaaauacgaaaaauggaucaauaaguuuaacauguuuagcauuaggugguguaaugauauucuuaaguacagcaguaagcgcagauguaggauguucuguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7045 - RNA, 2524 nt, Artificial Sequence
  KF383116.1 prME-long mRNA Design 2 opt
ggggcgcugccuacggagguggcagccaucuccuucucggcaucaagcuuaccaugagaauaauaaaugcaagaaaagagcgaaaaagaagaggagcagacacaucuauugggauaguaggacuauuauuaacaacagcgauggcggcugaaauuacaagaagaggaagugcuuacuauauguacuuagaccgaagugaugcuggcaaagcaauaucguucgcuacaacacuugggguaaacaaaugccacguucaaauaauggacuuaggacauaugugugaugcuacgaugagcuacgaauguccaauguuagaugaagguguagaaccagaugacguagacuguugguguaacacaacaaguacauggguaguuuauggaacaugucaacacaagaaaggggaagcaagacguagcagacgagcagugacacuaccuagucauaguacuagaaaacuacaaacaagaucacagaccugguuagaaaguagagaauauacaaaacaucuaauaaaaguagaaaauuggauauuuagaaaucccggauuugcccuaguugcaguagcaauagcaugguuauuaggaucaagcacaagucaaaaaguaauauauuuaguaaugauauuacuuauagcaccagcuuacagcauuagauguauagguguaucaaauagagacuuuguggaggguaugagcggaggaacauggguugauguaguauuagaacauggaggcuguguuacuguaauggcucaagacaaacccacaguagauauagaauuaguaacgacaacaguaucgaauauggcagaagucagaucuuauuguuacgaagcgagcauaucagacauggcaagugauaguagaugucccacucaaggugaagcauauuuagacaaacaaucagauacacaauauguauguaaaaggacauuaguagaccgggguuggggaaauggaugcggacuauuugguaaaggcagcuuaguuacaugugccaaauuuacauguucuaagaaaaugacaggaaaaaguauacaaccagaaaauuuagaauauagaauuauguuaaguguacauggaagccaacauucaggaaugaucguaaaugacauuggacaugagacugaugaaaauagagcaaaaguagagguaaccccaaauucuccuagggcagaagcaacacucggaggauucggaaguuuaggacuagauugugaaccaagaacaggacuagauuuuucagauuuauacuaucuaacaaugaauaauaaacauuggcuagugcauaaagaaugguuucacgacauuccgcuaccauggcaugcaggagcagauaccggaacaccacauuggaauaacaaagaagcucugguagaauuuaaagaugcacaugcaaaaaggcaaacgguaguaguucuuggaucacaagaaggagcaguacacacggcauuagcaggagcauuagaggcugaaauggauggugcuaaaggucggcuauuuucaggucauuuaaaaugcagguuaaaaauggauaaauugagauuaaaaggaguaagcuauagucuauguacagcuguuugcacagcugcaaaaguaccagcagaaacauuacauggaacuguaacaguagaaguacaauacgcaggaacagauggaccuuguaaaguaccagcacaaauggcuguagauaugcaaacacuuaccccaguaggacgauuaauuacagcaaaccccguaauaacagagucaacggaaaauaguaaaaugauguuagaauuagacccucccuuuggugauucauacauaguaauaggaguaggagauaagaaaauaacacaccauuggcacagaucaggcucaacaaucggaaaagccuucgaagcuacaguacgaggagcaaaaagaauggcaguauuaggagauacugcaugggauuuuggcaguguaggaggaguauuuaauaguuuagguaaagguauucaucaaauuuuuggagcagcuuucaaaucauuauucggaggaaugaguugguuuucacaaauacuuauaggaacacuauuaguaugguuaggacuuaauacgaaaaacgggucaaucagcuuaacauguuuagcacuagguggcguaaugauauuucuuucaacagccguuagugcagauguaggcuguuccguugauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7046 - RNA, 2506 nt, Artificial Sequence
  KU963574.2 prME-long mRNA Design 2 opt
ggggcgcugccuacggagguggcagccaucuccuucucggcaucaagcuuaccaugagaauaauaaacgcuagaaaagaacggaagagaagaggagcugaugcgucaauaggaauaguaaguuuauuauuaacaacaguaauggcugcagaaauuacaaggagaggaucagcuuauuauauguauuuagacagaagugaugcgggaaaagcaauaaguuuuguaacaacauuaggaguaaauaaaugucauguccaaauaauggacuuggggcauaugugcgaugcaacaaugucuuaugagugcccaauguuggaugaaggaguugaaccagaugauguagauuguugguguaauacaacaucaacuuggguaguauacggaacaugccaccacaagaaaggggaagcuagaagaucaagaagggcaguaacauugccaagucauaguacgagaaaacuacaaacacguagccagacauggcuugaaucaagagaauauacaaaacacuugauaaaaguagagaauuggauuuuccgaaauccagguuucgccuuaguugcaguagcaauugcaugguuacuaggaagcagcacuucucaaaaaguaauauauuuaguaaugauauuacuaauagcaccagcauauucaauaagauguauaggagugaguaacagagauuucguagaagguaugaguggaggaacauggguagacguaguacucgaacacgguggaugcguaacaguaauggcucaagacaaaccaacaguagauauugaacucguaacaacaacaguaucaaauauggccgaaguuaggucuuauugcuaugaggcaucaauaucagacauggcaucagauagcagauguccuacacaaggagaagcauauuuagauaaacaaucagacacacaauacguaugcaaaagaacauuaguagauagaggcuggggaaacggcuguggacuguuugggaaaggaucucucguaacaugcgcuaaauucaccuguaguaagaaaaugacaggaaaaaguauacaaccagaaaaccuagaauauagaauuauguuaagcgugcauggaagccaacacagcgggaugauaguuaaugaugaaaauagggcaaaaguagaggucacgccaaacagcccaagagcagaagcaacauuaggagguuucggaagccucggauuagauugugaaccaaggacuggauuagauuucucagauuuauauuaucuuacaaugaauaacaaacacuggcuaguacauaaagaaugguuucacgauauuccauuaccauggcauucaggagcagacacugaaacaccacacuggaauaauaaagaagcguugguagaauuuaaagaugcacacgcaaaaagacaaaccguaguagucuuagguucgcaagaaggagcaguacauacagcacuagcaggcgcgcuagaagcugaaauggauggugcaaaaggaagacugucaucaggucaucuaaaauguagauuaaaaauggauaaauuaagacuaaaagguguaucauauuccuuauguaccgcagcguuuacuuucacaaaaguuccagccgaaacauuacauggaacaguaacuguagaaguacaauaugcagggcgagacggaccuuguaaaguuccagcacaaauggcaguugauaugcaaacauuaacaccaguugggagauuaauaaccgcaaacccaguaauaacugaaucaaccgaaaauucaaagaugauguuagaauuagaucccccauuuggagacuccuauauagugauaggaguuggagauaagaagauaacccaucauuggcauagaucaggaagcauuauaggaaaagcauuugaagcaacaguaagaggcgcaaaaagaauggcaguacuaggcgauacggcaugggacuuuggaucagugggaggaguuuucaacagucuaggaaaagguauucaccaaauauucggagccgcauucaaaagccuauucggagguaugucaugguuuucacagauucuaauaggaacgcuucuaguaugguugggauuaaauacuaaaaauggaaguauaucacuaacaugucuugcuuuaggaggaguaaugauauucuugucaacagcaguuucugcagacguuggaugcaguguggauuuuaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7047 - RNA, 2506 nt, Artificial Sequence
  KX601166.1 prME-long mRNA Design 2 opt
ggggcgcugccuacggagguggcagccaucuccuucucggcaucaagcuuaccaugagaauaauaaaugcaagaaaagaaagaaaaagaagaggagcugauacaucuauuggaauaguaggcuuguuauuaacaacagcuauggcagcagaaauaacaagaagaggaagcgcuuacuauauguauuuagacaggagugaugccggaaaagcaauaucauuugcaacaacauuaggggucaauaaaugucauguccaaauaauggacuuaggacauaugugcgacgcaacaaugaguuaugaguguccaauguuggacgaaggaguagaaccagaugauguagauuguugguguaauacgacuuccacauggguaguuuacggaacuugucaucauaagaaaggagaagcuagaagaagcaggagagcaguaacacuaccaucacauaguacuagaaaacuucaaacaagaagccaaacauggcuagagucaagagaauauacaaaacacuugauaaaaguagaaaauuggauauuuagaaauccaggcuuugcauuaguggcaguagcuauagccuggcuuuuaggaagcaguacaagucaaaaaguaauauauuuaguaaugauauuauuaauagcaccagcauauucaaucagaugcaucggagugaguaauagagacuucguagaagguaugagcggaggaacauggguagaugugguacuagaacacggaggcuguguaacaguaauggcacaagauaagccgaccguagauauugaauuaguaaccaccaccgugaguaauauggcagaaguuagaucauauugcuaugaagcaaguaucagugauauggcaagcgauaguagauguccgacacaaggagaagcauaccuagauaaacaaagcgacacacaauacguauguaaaagaacacucguagauagaggauggggaaacggauguggauuauuugggaaaggaucccuaguaacaugugccaaauuuacuuguucgaagaaaaugacuggaaaaaguauacaaccugaaaacuuagaauauagaauaaugcuaucaguacaugguagccaacauagcggaaugauaguaaaugaugaaaacagggcaaaaguagaaguaacgccuaauagcccaagagcagaagcuacacuagguggauuuggaaguuuaggacuagauugcgaaccacgaacgggguuagauuuuagugacuuauauuauuuaacuaugaacaauaaacauugguuaguacacaaagaaugguuucacgacauaccauuacccuggcaugcaggagcggauacaggaacaccacauuggaauaacaaagaagcucuaguggaauuuaaagaugcacaugcaaaaaggcaaacaguuguaguacugggaucacaagaaggagcgguucauacagcccuagcaggagcacuagaagccgaaauggauggagcgaaaggaagauuauucucaggacauuuaaaaugucgauuaaaaauggacaaacuacgauuaaaaggaguuaguuacucauuauguacagcagccuucacguuuacaaaaguaccagcagaaacacuacacggaacaguaacuguagaaguacaauacgcuggaacagauggaccuuguaaaguaccugcccaaauggcgguagauaugcaaacauuaacaccuguggguagguuaauaacagcaaauccaguaauaacugaaucaacagaaaacaguaaaaugauguuagaauuagauccacccuuuggugauagcuauauagucauaggaguaggugacaagaaaaucacacaucauuggcaccgaaguggcucaacgauagguaaagcauucgaagcaacaguucgaggagcuaaaagaauggcaguacuaggagauacagccugggauuuugggaguguagguggaguauucaauagccuagggaaaggaauacaccaaauauucggggcagcauucaaaagucuauuuggugguaugaguugguuuucacaaauauuaauaggcacuuuauuaguauggcuaggguuaaauacuaaaaacggaagcauuagcuuaacaugccuagcgcugggagguguaaugauauuucuaaguacagcaguaagugcagauguaggauguagcguugauuuuucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7048 - RNA, 2524 nt, Artificial Sequence
  KF383118.1 prME-long mRNA Design 2 opt
ggggcgcugccuacggagguggcagccaucuccuucucggcaucaagcuuaccaugagaauuauaaaugcaagaaaagaaagaaaaagaaggggagcugacacuucaauaggaauaauaggauuacuacuuaccacagcaauggcagcagaaauaacacgaagaggaucugcauauuacauguaucucgauagaagcgacgcagguaaagccauaaguuuugcaaccacauuagguguaaauaagugucauguacaaaucauggacuuaggacauaugugugacgcaaccaugagcuaugaaugcccuaugcuagacgaaggaguagaacccgaugacgucgacuguuggugcaacacuacaagcacaugggucguuuaugguaccugucaucauaagaaaggagaaacucgaagaucaagaagaaguguaucucuuagauaucauuacacaagaaaacuacagacaagaucucaaacauggcuagaaucaagagaauauaagaaacaucuaauaaugguugaaaauuggauauucaggaacccaggauuugcaauaguuaguguugcaauaacauggcuuaugggaaguuuaacaagccaaaaaguuauauacuuaguaaugauaguucuaauuguaccagcuuauucaauaagcugcauaggagugaguaacagagauuuagucgaaggaaugucagguggaacauggguagauguaguauuagaacaugggggaugcguuacagaaauggcccaagauaaaccgacaguagauaucgaauuaguaacaaugaccguaucaaacauggccgaaguaagaucauauuguuaugaagcaucacuaucagauauggcaagugcaagcagaugcccaacucaaggggaaccaucucuagauaaacaaucagacacacaaucaguaugcaaaagaacauugggugauagaggauggggcaacggcuguggcauuuuuggaaaaggaagucuaguuaccuguaguaaauucacgugcuguaagaaaaugccaggaaaaaguauucaaccagaaaaccuugaauacagaauuauguuaccaguacauggaucgcaacauaguggcaugauagugaaugauauaggucacgaaacagacgaaaauagagcaaaaguugaagugacaccaaacaguccaagagcagaagcaacauuaggaggauuuggaucauuaggauuagauugugaaccacgaaccgggcuagauuucagcgaucuuuauuacuuaacgaugaauaauaaacacuggcuaguacauaaagaaugguuccaugacauaccauuaccauggcacgcaggagcagauacuggaacuccacauuggaauaauaaagaagcacuuguugaguucaaagaugcacaugcaaaaaggcaaacaguaguaguacuaggaagccaagaaggagcuguucacacagcguuagcaggcgcacuugaagcugaaauggauggagcaaaaggaagauuguuuucaggacauuuaaagugcagacuuaaaauggacaaacuaagacuaaaaggcgucucuuacucauuauguacagcagcauuuacauucacuaaagugccagcagaaacacuacauggaacugucacaguagaaguccaaucugcagguacagauggcccauguaaaguacccgcccaaauggcaguugacaugcaaacgcugacaccaguagguagacuaauaacagcaaacccuguaaucacagaaucaacagaaaacuccaaaaugauguuagaacuagauccaccuuucggagauaguuauauuguaauuggaguaggagauaagaaaauaacacaucauuggcauagaagcggaaguacuauaggaaaagccuucgaagcuacaguaagaggcgcuaaaaggauggcugucuuaggugauacagcuugggauuuuggaucaguaggggguguauucaauagucuaggaaaaggaauacaucaaauuuuuggagccgcguucaaaaguuuauucggagguaugucgugguuuucacaaaucuuaauaggaacauuacugguauggcuaggacuaaauacuaaaaauggcaguauuagcuuaacauguuuagcuuuaggaggaguaaugauauuucuuagcacagcaguuagugcggaugucggauguucuguagacuuuucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7049 - RNA, 2518 nt, Artificial Sequence
  KF383120.1 prME-long mRNA Design 2 opt
ggggcgcugccuacggagguggcagccaucuccuucucggcaucaagcuuaccaugagaauuauuaacgcucguaaagaaagaaaaagacguggugcagacacaagcauagggauaauagguuugcuauuaacaacugcaauggcugcugaaauaacaagacgaggaucagcauauuauauguaccuggauaggucugaugcaggaaaagcaauaucauucgcaacuacaaugggaguaaauaaaugucauguacaaauaauggauuuaggacacaugugugaugcuacaaugaguuaugaauguccuauguuagacgaaggaguagaaccugaugauguugacuguugguguaauacuacuagcacauggguuguauaugggaccugccaucauaagaaaggagaagcaaggccaucaagacgagcagucacauuaccgagucauaguacucgaaaauuacaaacucgaagucaaacgugguuagaaucacgugaauacacaaaacacuuaauaaaaguagaaaauuggauacuucgaaacccuggguuuacgguagcagccuuagcaauggcauggcuucuaggaaauaguacaagucaaaggguaauauaccuaguaaugauuuuauuaauagcacccgcauauucaauaagaugcauaggaguaagcaauagagauuuuguagaagguaugucaggaggaacauggguagauguuguacuagaacacggcggaugcguaacaguuauggcucaagacaaaccaacaguagauauagaauuaguaacuacaacaguaucaaauauggcugaaguaaggaguuauuguuaugaggcaaguaucucagauauggcaagugacaguaggugcccaacccaaggcgaggcuuaucuagauaaacaaagugauacucaauacguauguaaaaggacgcuaguagauagaggauggggaaacgguuguggacuauuuggaaaaggaagccuaguaacaugugccaaauuuacauguucaaagaaaaugacaggaaaaaguauacaacccgaaaaucuagaauauagaauuaugcuaaguguacauggaucucaacacucaggaaugauaguaaaugacauaggacaugaaacagaugaaaauagagcaaaaguggaaguuacaccaaauaguccaagagcagaagcuacacuggguggauucgggagcuuaggguuagauugugaaccaaggacaggauuagauuucucagaucuauacuaucuaacaaugaacaacaaacauugguuaguucauaaagaaugguuucacgacauaccacuaccauggcacgcaggagcagauacaggaacaccacauuggaacaauaaagaagcauuaguagaguucaaagacgcacaugcuaaaagacagacaguaguuguucuaggaagccaagaaggagcuguacauacagcacuugcaggagcacuugaagcagaaauggauggugcaaaagggagacuuuucagcggacacuuaaaaugccgaauaaaaauggauaaauuaagauuaaaaggugucucguauucuuuauguacagcagcauuuacauuuaguaaaguaccagcagaaacauuacaugguacgguaacagucgaaguacaauaugcaggaagagauggaccauguaaaguaccagcacagauggcaguagauaugcaaacauuaacaccuguagggagauuaauaacggccaauccuauaauaacagaaaguacagaaaauucacgcaugaugcuugaacucgauccaccauucggagauaguuauauagugauaggaguaggugauaagaaaauaacccaucauuggcauagaaguggaaguacuauagguaaagcauucgaagcaacagugagaggagcuaaacgaauggcaguauuaggcgauacagcuugggauuuugguaguguagguggaguauucaauagucuaggaaaaggaguacaccaaguauucggagcggcauuuaagagcuuguucggaggaaugagcugguucucacaaauacuuauagguacauuauuaguauggcuaggauuaaauacuaaaaacggaaguauuucauuagcaugucuugcucuagguggugcaaugauuuuucuaagcacugccguuucugcagacguugguuguagcguagauuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7050 - RNA, 2449 nt, Artificial Sequence
  KU321639.1 prME-short mRNA Design 2 opt
ggggcgcugccuacggagguggcagccaucuccuucucggcaucaagcuuaccaugacuagcguaggaauaguaggauuauuauuaacgacagcaauggcugcagaaguaacucgacgcggaucagcauauuauauguaccucgacagaaaugacgcaggagaagcaauuaguuucccuacaacauuagggaugaauaaauguuauauccaaaucauggauuuaggacacaugugugaugcaacaaugagcuacgaauguccaauguuagacgaagguguagaaccagacgacguagacuguuggugcaauacaacaucaacauggguaguauaugguacaugccaucauaagaaaggcgaagcuagaagaaguagacgagcaguaacacuaccaucacauagcacaagaaaauuacaaacaagaucucaaaccuggcuagaaucaagagaauauacuaaacauuugauaagaguagaaaauuggauauuuagaaauccaggauucgcuuuagcagcagcugccauugccuggcuuuuaggaucaucaacaagccaaaaaguaauauauuuaguaaugauauugcuuauagcgccagcauacagcauaagauguauaggaguuucaaauagagauuuugucgaaggaaugagcggaggaacauggguagauauaguacuugaacauggaggaugcgugacaguuauggcccaagacaaaccuaccguagacauagaauuaguuacaacuacuguaucuaauauggccgaaguaagaaguuauugcuacgaggcuucaauuagugacauggcaucagauucuagaugcccaacucaaggugaagcauaccuagacaaacaaagugacacgcaauacgucuguaaaagaacauuaguagacagaggauggggcaauggaugcggauuauucggaaaaggcagcuuaguaacuugugcaaaauucgcauguagcaagaaaaugacaggaaaaucaauacaaccagaaaacuuagaauacagaaucauguugucaguucauggcagccaacauucaggaaugauaguaaacgauacuggacaugaaaccgaugaaaauagagcaaaaguagaaauaacuccaaauaguccuagagccgaagccacauuaggugguuuuggaucauuaggacuagauugugaaccacgaacaggacuagauuuuagugauuuauauuaucuaacgaugaauaauaaacauugguuaguacauaaagaaugguuucaugauauaccacuuccauggcaugcaggagccgauacuggaaccccacacuggaauaauaaagaagcauuaguugaguucaaagaugcccacgcaaagagacaaacaguaguaguauuaggaucacaagaaggggcaguacauaccgccuuagcuggagccuuagaagcagaaauggacggagcuaaaggaagacugaguagcggacacuugaaaugucgacugaaaauggauaaguuaagguuaaaaggaguaaguuauaguuuauguacagcugcauuuacauuuaccaaaauaccagccgaaacccugcaugggacgguuacaguagaaguacaauaugcaggaacggauggaccauguaaaguaccagcgcagauggcaguugauaugcaaacacuaacaccaguaggaagacuuauaaccgcaaauccggugauaacagaaaguacagaaaacuccaaaaugauguuagaauuagauccaccauuuggagacucauauauagugauaggagugggagaaaagaaaauaacacaccauuggcauagaaguggaaguacaauaggaaaagcguucgaagcaaccguaagaggagcaaaaagaauggcaguucuaggagauacugcaugggauuucgguagcguaggaggagcauuaaauucacuaggaaaaggaauccaucaaauauuuggagcagcauucaaaaguuuauucggaggaaugaguugguuuucccaaauacuaauaggaacacuauuaaugugguuaggauugaauacgaaaaauggaucuauaucgcugaugugucuagcauuaggaggagucuuaauuuucuuaucaacagcaguaucagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7051 - RNA, 2449 nt, Artificial Sequence
  KU312312.1 prME-short mRNA Design 2 opt
ggggcgcugccuacggagguggcagccaucuccuucucggcaucaagcuuaccaugacaucaguuggaauagucggacuucuuuugacaacagcaauggcugcugaaguuacgcgaagaggaagugccuauuacauguauuuggacagaaaugaugcaggagaggcuauuucauucccaacaacauuagggaugaacaaauguuauauacaaauaauggaucuuggucauacaugcgacgcgacgaugucauacgaauguccaaugcuugaugaaggaguagaaccugacgauguagacuguuggugcaacacaacaucaacuuggguaguauauggaacuugucaucacaaaaaaggggaggcaaggagaucacguagagcaguuacacuaccuucacauaguacaagaaaacuacaaacaagaucacaaacauggcucgaaucacgagaauauacaaaacauuuaauaaggguagaaaauuggauuuucagaaacccaggauuugcccuugcagcagcagcaauugcauggcuuuuaggaaguagcacaagucagaaagugauauacuuagugaugauuuuacuuauagcuccagcauauucuauaagaugcauaggaguaaguaauagagacuucguagaaggaaugaguggggguacuuggguagauguuguacuugaacacggcggaugcguaacaguaauggcccaagauaaaccaacuguagauauagaauuaguaacgacaacaguuucaaauauggcagaaguaagaucauauugcuacgaagcauccauaucagacauggcuucugauucuagauguccaacucaaggugaagccuauuuagauaaacaaucagauacucaauauguauguaaaagaaccuuaguagacagagguuggggaaauggaugcggauuauuuggaaaaggaagucuaguaacgugugcaaaauuugcaugcaguaaaaaaaugacuggaaaaaguauucaaccagaaaaccuugaauauagaauaauguugaguguacaugguagccaacauucaggaaugauaguaaaugauacaggccacgaaacagacgaaaauagagcaaaaguugaaauaacaccaaauagucccagagccgaagcaaccuuaggaggauucggaucucuaggauuagacugcgaaccuagaacaggacuagacuuuucagaucuuuacuauuuaacaaugaauaauaaacauuggcuagugcauaaggaaugguuucacgauauaccauuaccauggcaugcaggagcugauacagguacaccacauuggaauaauaaagaagcacuuguagaauucaaagacgcacacgcuaaacgacaaacaguaguaguauuagguagucaagaaggagcaguucauacagcauuagcuggggcauuagaagcagaaauggauggagcaaagggaaggcuaucaucaggacauuuaaaaugcagauuaaaaauggauaaauugagacucaaagguguaucauauucucuauguacagcagcuuucacuuuuacaaaaauaccagcagaaacucuucaugggacuguuacaguugaaguacaauaugcaggaacagaugguccaugcaaaguaccagcacaaauggcaguagauaugcaaacauuaacaccaguaggaagacugauaacagcaaacccaguaauaacagaaagcacagaaaauucaaaaaugauguuagaauuagauccuccauucggagauucauauauagucauaggaguaggagaaaaaaaaauaacacaucauuggcauagaucaggaucaacuauaggcaaagcauuugaagcaacaguaagaggcgcaaaaagaauggccguacuaggagacacagcuugggacuucggaagcguaggaggagcacuaaauaguuuaggaaaaggaauucaccaaauauuuggagcagcauuuaaaaguuuauucggaggaaugagcugguucucacaaauauuaauagguacuuuacuaaugugguuaggacuaaaugccaaaaacggaucaauaagcuuaaugugcuuagcucuuggaggugugcuaauauuccuuucaacagcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7052 - RNA, 2437 nt, Artificial Sequence
  AY632535.2 prME-short mRNA Design 2 opt
ggggcgcugccuacggagguggcagccaucuccuucucggcaucaagcuuaccaugacaucaauuggaauaauuggucuuuuacuuacuacagcaauggcagcagaaauaacaagaagaggaucagcauauuauauguauuuagaccguagcgaugccggaaaagcaauaucauucgcuacaacauuaggaguuaauaaaugucauguucaaauaauggacuuaggacauaugugugaugcaacuaugucuuaugaauguccaaugcuagacgaaggaguagaaccagaugauguagauugcugguguaauacuacuagcacauggguuguauaugguacaugucaucauaagaaaggcgaagcuagaagaaguagacgagcaguaacuuuaccaucucauucgacaagaaaauugcagacgagaucacaaacaugguuagaaaguagagaauauacuaaacauuuaauuaaaguagaaaacuggauauuuagaaauccggguuuugcauuaguggcagucgcuauugcaugguuauuaggcucaucaacgagucaaaaaguaauauaucuaguaaugauacuauugauagccccagccuauucaauaagaugcauaggaguaaguaauagagauuuuguagaagguaugagcggaggcacuuggguagaugucguuuuagaacacggaggaugcguaacaguaauggcucaagacaaaccaaccguagauauagaguuaguuacaacaacaguaaguaauauggcagaaguucgaucuuacuguuaugaagcaucaauaucagauauggcuagcgacucuagaugccccacacagggagaagccuacuuagauaaacaaagugauacccaauacguauguaaaagaacccuaguagauagaggauggggcaaugggugcggacuauuugguaaaggaucucuagugacaugcgcaaaauucacaugcucaaagaaaaugacaggaaaaaguauccaaccagaaaauuuagaauauagaauaauguuaucuguacauggcucacaacauucagguaugauaggauaugaaacugaugaagacagagcaaaaguagaagucacaccaaacuccccaagagcagaagcaacacuuggcggguuuggaaguuuaggauuagacugugaaccuagaacaggauuagacuucagugauuuauauuaccuaacgaugaacaauaaacacugguuaguacauaaagaaugguuucacgacauaccauuaccguggcaugcaggagcagauacuggaacaccucauuggaacaauaaagaagcauuggucgaguucaaagaugcucaugcaaaaagacaaaccguaguaguauuaggaucacaagaaggagcuguacauacagcauuagcaggagcgcuagaagcagaaauggauggagcaaaaggaaggcuauucucaggccaucuaaaauguaggcuuaaaauggauaaacuacgacugaaaggaguaaguuacucauuauguacagcagccuucaccuucacgaaaguaccagccgaaacucuacacggaacaguaacuguagaaguacaauaugcagguacagauggacccuguaaaauaccaguacaaauggcaguagauaugcaaacauuaacaccaguaggaagauuaauuacugcaaauccaguaauaacagaaaguacagaaaauucaaaaaugaugcuugaacuugaucccccauuuggagauucauauauaguaauaggaguaggagauaagaaaauaacacaucauuggcauagaucaggaucgacaauuggaaaagcauucgaagcaacaguaagaggagcgaaaagaauggcuguauuaggagacacagcgugggauuuuggaucagugggaggugucuuuaauagcuuaggaaagggaauacaccaaauauucggugccgcguuuaaaucacucuuuggaggcaugucaugguucagucaaauacuaauaggaacucuguuaguguggcuaggauuaaauacgaaaaauggaagcauuagcuuaacauguuuagcauuaggaggagugaugauauuccuaaguacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7053 - RNA, 2449 nt, Artificial Sequence
  KU527068.1 prME-short mRNA Design 2 opt
ggggcgcugccuacggagguggcagccaucuccuucucggcaucaagcuuaccaugacaucaguaggaauuguuggauuauuacuaacaacagcuauggcagcugaggucacaagaagaggaucugcauauuauauguauuuagauaggaaugaugcaggagaagcuauaaguuucccgacaacccuagguaugaauaaauguuauauucaaauaauggaucuaggacacaugugugaugcuacaaugucauacgaaugcccuauguuagaugaaggcguagaaccagacgauguagauugcugguguaauacaacgagcacauggguaguauauggaacuugccaucauaagaaaggagaagcuagaagaaguaggagagcuguaacauuaccuagucauaguacaagaaaauuacaaacaagaucgcaaacaugguuggaaucaagagaauauacgaaacauuuaauaagaguagaaaauuggauauuuagaaauccaggguucgcuuuagcagcggcugcuauugcaugguuauuagggaguagcacuucacaaaaaguaauauauuuagugaugauauuauuaauagcuccagcauauucaauaagaugcauaggagugucaaauagagauuucguagaaggaaugucggguggaacauggguagauguaguuuuggaacauggcgguugcguaacaguaauggcucaagacaaaccuacaguagauauagaauuaguaacaacaacaguaaguaauauggcagaaguuagaucuuauugcuaugaagcaucaauuucagauauggcaagugacucacgaugccccacacaaggggaagcauaccuagacaaacaaucagauacucaauacguauguaaaagaacauuaguagaccgggguuggggaaacggaugcggucuauucggaaaaggaagucuaguaacaugugcuaaauuugcauguaguaagaaaaugacagggaaaaguauucagccugaaaacuuagaauauagaauaaugcugucuguacauggaagucaacauagugguaugauaguaaaugauacaggacaugaaacagacgaaaauagggcaaaaguggagaucacgccaaacaguccuagagcagaagcuacacuaggagguuuuggaagucuagggcuagauugugaacccagaacuggauuagauuuuucggauuuauacuacuuaacaaugaacaacaaacacugguugguccauaaagaaugguuucaugauauaccauuaccauggcaugcgggcgcagauacaggaacaccacauuggaauaacaaagaagcauuagucgaauuuaaagaugcccaugcaaaaagacaaaccgugguagucuuaggaagucaagaaggagcaguacauacagcacuagcuggcgcgcuugaagcagaaauggauggagcuaaaggaaggcuaucgucaggacauuuaaaauguagguugaaaauggauaaacuaaggcuaaaaggaguuaguuauagcuuguguacugcagcauucacguuuacaaaaauaccagcagaaacauuacacgguacaguuacaguugaaguacaauaugcagggaccgauggaccauguaaaguacccgcacaaauggcuguagauaugcagacacuaacacccguaggaagacuaauaacagcaaauccugucauaacagaaaguacagaaaacucaaaaaugaugcuugaauuagauccaccauuuggagauucuuacauaguaauaggaguaggagaaaagaaaauaacucaucacuggcaucgaaguggaaguacaauaggaaaagcauuugaagcaaccguuagaggagcaaaaagaauggcaguauuaggagacacagcuugggauuuuggaagcguaggaggagcauuaaacucauuagggaaagguauacaucaaauuuucggagcagcauuuaaaagucuauuugggggaaugucaugguuuagucaaauauuaauagguacauugcuaaugugguuaggacuaaauacuaaaaauggaaguauaaguuuaauguguuuagcacuuggaggaguacuaauauuuuuaagcacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7054 - RNA, 2449 nt, Artificial Sequence
  KX421193.1 prME-short mRNA Design 2 opt
ggggcgcugccuacggagguggcagccaucuccuucucggcaucaagcuuaccaugaccucaaucgguauuauaggacuacuauuaacaacagcaauggcggccgaaauaacgagaagaggaucagcauauuacauguaucuagaccgaagugaugcaggaaaagcaauaucuuuugcuacaacacuaggaguaaacaaaugucauguacaaauuauggacuuaggacauaugugugacgcgacaaugucauacgaaugucccauguuagaugaaggaguugaaccagaugauguagacuguugguguaacacaaccaguacuuggguaguauacgguacaugccaucacaagaaaggagaagcaagaagaaguagacgagcagugacauuaccaagccacucaacgagaaaauuacaaacaagaagucaaacauggcuagaaaguagagaauacacuaaacaucuaauaaaaguagaaaauuggaucuucagaaauccaggauuugcauuaguagcaguugcaauugcaugguuauuaggaucaucaaccagccaaaaaguuauuuauuuaguaaugauccuauuaauugcaccagcauacaguauuagaugcaucggcguuucaaauagagauuuuguugaagguaugucaggaggaacauggguagauguaguauuagaacaugguggauguguaacuguuauggcacaagauaaaccuacaguggacauugaauuaguaacaacaacaguauccaacauggcagaaguuagaucauacugcuaugaagcaagcauaagugacauggcuucagauucaagauguccuacacaaggagaagcauaucuggacaaacaaucagauacucaauaugucugcaaaagaacauuaguugauagaggcuggggaaaugggugcggcuuauucggaaaagguagucuagucacaugcgcuaaauuuacauguaguaagaaaaugacaggaaaaucaauccagccagaaaacuuagaauacagaauuauguugucaguacauggaucucaacauagugguaugauuguaaacgauacaggauacgaaacagaugaaaauagagccaaaguagaaguuaccccuaacucaccaagagcagaagcaacucuaggaggauuuggauccuuaggacuagauugugaaccaagaacaggcuuagauuuuucagaucuauauuaccuuacaaugaacaauaaacacugguuaguacauaaagaaugguuccacgauauaccacuaccauggcacgcaggagcggacaccgguacaccacacuggaauaauaaagaagcauuaguugaguucaaagaugcucaugccaaaagacaaacaguaguaguuuuaggaucucaagaaggagcaguacauacagcuuuagcaggagcauuagaagcagaaauggacggagcaaaaggaaaauuauuuucaggacauuuaaaaugcagauuaaaaauggacaaauugagauuaaaaggcguaaguuauucacuauguacggcagcauucacauuuacuaaagucccagccgaaacacugcauggaacaguuacaguagaaguucaguacgcaggcacagauggaccaugcaaaauaccuguacaaauggcaguagauaugcaaacccuaacaccagucggaagacuuauaacugccaauccaguuauaacagaaucaacugaaaacuccaaaaugauguuagaauuagauccaccauuuggagacaguuauauaguaauuggaguaggagacaagaaaauuacacaucacuggcaucgaaguggaaguacaauaggaaaagcauuugaagcuacaguaagaggagcuaaaagaauggcaguacuaggugauacagcaugggauuuugguucuguaggagguguauuuaauagucuuggaaaaggaauacaucaaauauuuggagccgcauuuaaaucauuauuuggaggaaugucaugguucucacaaauacuaauuggcacauuauuaguauggcuaggacuaaacaccaaaaacggaagcauaaguuuaacaugucuagcacuaggaggaguaaugauauuucuaaguacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7055 - RNA, 2449 nt, Artificial Sequence
  KX377335.1 prME-short mRNA Design 2 opt
ggggcgcugccuacggagguggcagccaucuccuucucggcaucaagcuuaccaugacaucaauaggaauuauuggucuacuucuaacaacagcaauggcugcagaaauaacaagaagaggaagugcauauuacauguauuuagacagaucagacgcuggaaaagcgaucaguuucgcaacaacuuuaggaguaaauaaaugucauguacaaauaauggauuuaggucacaugugugacgcaacuauguccuaugaauguccaauguuagacgaaggaguugaaccagaugauguugauuguugguguaauacaacaucuacaugggucguauauggaacaugucacaggaaaaaaggggaagcaagaagaucuagaagggcaguaaccuuaccaagucauucaacaagaaagcuacaaacaagaagccaaacauggcuagaaaguagagaauacacuaaacacuuaauuaaaguagaaaauuggauauuuagaaauccaggauucgcauuaguugcaguagcaauagcaugguuauuaggcucgucaacaagucaaaaaguuaucuauuuaguaaugaucuuacuaauagcuccagccuauucaauuaggugcaucggcguaucaaauagagacuuuguagaaggaaugagcggagguacauggguagacguaguauuagaacauggaggaugcguaacaguuauggcucaagauaaaccaaccguagauauagaacuaguaacaacaacaguuaguaauauggcagaaguuagaagcuauugcuaugaagcgucuauaucagauauggcaucagauaguagguguccaacacagggagaagcauacuuagacaaacaaucggauacucaauauguauguaaaagaacauuaguagauagaggcugggguaacggaugcggauuauucggaaaaggaucauuagugaccugugcuaaauuuaccugcucaaaaaaaaugacgggcaaaucaauacaaccugaaaaucuagaauaccgcauaaugcuuaguguacauggaucccagcauucaggaaugauaguaaacgauacaggcuacgaaacagaugaaaauagagcaaagguagaaguuacaccuaauucaccacgagcagaagcaacauuaggaggauuuggaagucuagguuuagauugugaaccaagaacaggauuagauuuuucagaucuauauuauuuaacaaugaacaauaaacauuggcuaguacauaaagaaugguuucaugauauaccauuaccuuggcaugcaggugcagauacaggaacaccucauuggaauaauaaagaagcccuugucgaguucaaagaugcacacgccaaaagacaaacuguagucguacuaggaagucaagaaggugcaguacacacagcuuuagcaggagcacucgaagcagaaauggacggagcgaaaggaaaacuguucagcggacauuuaaaaugccgauuaaaaauggacaaauugagacuaaaaggaguaucauacucuuuauguacagcagcauuuacauuuacaaaaguuccagcagaaacauuacauggaacaguaaccguagaaguacaauaugcaggaacugacgguccaugcaaaauaccaguucaaauggcaguagacaugcaaacauuaacuccaguggguaggcuaauuacagcaaacccuguaauaacagaaagcacggaaaacucuaaaaugauguuagaacuagauccaccauuuggagauucauacauaguaauuggaguaggagauaaaaaaauuacacaucauuggcauagaaguggaucaacaauaggaaaagcauucgaagcaacuguacgaggggcaaaaagaauggcaguacuaggcgacacagcaugggauuuuggaaguguuggggguguauuuaauucuuuaggaaaaggaauacaucaaauauuuggagcggcauucaaaucauuauuuggaggaaugagcugguuuagucaaauuuuaauagguacuuugcuaguaugguuaggauuaaauacaaaaaacggaucaauaagccuaaccuguuuggcuuuaggaggaguaaugauauucuuaagcacagcagucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7056 - RNA, 2449 nt, Artificial Sequence
  LC002520.1 prME-short mRNA Design 2 opt
ggggcgcugccuacggagguggcagccaucuccuucucggcaucaagcuuaccaugaccagcauaggaauaaucggacuguuauuaacgacagcuauggcagcugaaauaacaagaaggggauccgcguacuacauguacuuagauagaucugaugcuggaaaagcaauaucauucgcuacaacacucggaguaaacaaaugucauguacaaauaauggaucuaggacacaugugugaugccacaauguccuacgaauguccuauguuagaugaaggaguugagccagaugauguagauugcugguguaauacaacuuccacauggguaguauauggcacaugccaucacaagaaaggagaagcuagaagaaguaggagagccguaacacuaccaagccauaguacaaggaaauuacaaacaagaagucagacuuggcuagaaaguagagaauauacaaaacaucugauaaaaguagaaaauuggauauucagaaauccaggauuugcucuaguagcaguagcaauagcaugguuauuaggaagcucaacaagccaaaaaguuaucuauuuaguaaugauauuauuaauagcuccagcguauuccauaagaugcauaggaguaaguaauagagacuuuguagaaggaaugaguggugggacauggguagauguugucuuagaacaugggggauguguaacagugauggcucaagacaaaccaacaguugacauagagcuaguaacuacaacaguaaguaacauggcagaaguaagaucauacuguuaugaagccuccauaucagauauggcauccgacagucgauguccaacacaaggugaagcauauuuggacaaacaaagugauacacaguauguaugcaagagaacauuaguugauagaggaugggguaacggguguggauuauuuggaaaagguucacuggugacaugugcaaaauuuacaugcucaaagaaaaugacuggaaaaagcauacaaccagaaaauuuagaauauagaauuauguuaucaguucacggaagccaacauaguggaaugacuguaaaugacauaggauaugaaacagacgaaaacagagcaaaaguugaaguaacgccaaauucaccuagagcagaagcuacauuaggaggauuuggcaguuugggauuagauugugaacccagaacaggacuugacuucagugauuuauauuaucugacaaugaacaauaaacauugguuaguacauaaagagugguuucaugauauaccauuaccguggcaugcaggagcagacacaggaacuccacacuggaacaauaaagaagcucuaguagaauuuaaagacgcacacgcuaaaagacaaacaguaguagucuuagggucacaagaaggcgcaguacacacagcuuuagcaggagcauuagaagcagaaauggacggcgccaaaggcaaacuauuuucuggccauuuaaaguguaggcuaaaaauggacaagcuaagauuaaaagggguaucauauucauuaugcacagccgccuuuacauuuacaaagguuccagcagaaacacugcauggaacagugacaguagaaguccaauaugcaggaacagauggaccauguaaaauaccaguacaaauggccguagacaugcaaacauuaacaccaguaggaagacucauaacagcaaacccugucauuacagaaagcacagaaaauucuaaaaugaugcuagaauuagauccaccuuuuggagauucuuauaucgugauaggaguuggagauaagaaaauaacacaucauuggcauagauccggaaguacaauaggaaaagcguuugaagccacaguaaggggagcaaaaaggauggcaguacucggagauacagcgugggauuuugggucaguuggaggaguuuuuaauagucuaggaaaagguauacaccaaauauuuggggcagcauucaaaucuuuauucggaggaaugagcugguuuucacaaauauuaauaggcacacuacuuguaugguuaggauuaaauaccaaaaauggaucaauaaguuugacaugccuagcgcuaggagggguaaugauauuucugucaacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7057 - RNA, 2431 nt, Artificial Sequence
  DQ859059.1 prME-short mRNA Design 2 opt
ggggcgcugccuacggagguggcagccaucuccuucucggcaucaagcuuaccaugacaaguauagguauaguaggccuucuacuaacgacagcaauggcagcugaaauaacaagaagagguucagcauauuauauguaucuagauagaagugacgcaggaaaagcuauuagcuucgcaacuacuuuaggaguuaauaaaugucauguacaaauaauggacuuaggacauaugugcgaugcaacaaugaguuaugaaugcccaauguuagaugaaggaguagaaccagacgauguagauugcuggugcaauacuacaucgacauggguaguguacggcacaugucaucacaagaaaggagaagcgagaagaucaagaagggcaguaacacuaccaagccauaguacgagaaaauuacaaacacgaucucaaacaugguuagaaucaagagaauauacaaaacacuuaauaaaagucgagaacuggauauuucggaauccaggauucacccucguugcaguagccauagcuuggcuacuaggauccucaacuagccaaaaaguaauuuauuuaguaaugauauuauuaauagcuccagcauauucaauaagauguauagguguaucuaacagagauuuugucgaaggcaugucaggaggaacauggguagauguaguucuagaacauggaggaugcguaacaguuauggcacaagacaaacccacuguagauauagaauuaguaacgacaacaguaucaaauauggcagaaguacgaagcuauugcuaugaagccucaauaucagacauggcuucagauucaagauguccaacacagggugaagcauaucucgacaaacaaucggacacacaauauguauguaaacgcacauuaguagauagaggaugggguaauggaugcggucuauucggaaaaggaucauuaguaacaugugcaaaauucacuugcucuaagaaaaugacgggaaaaucaauucagccagagaauuuagaauaccguauaauguuaucuguucauggaucacaacauucugggaugauaguaaaugaugaaaauagagcaaaaguagaagugacaccaaauucaccaagagcagaagcuacacuaggaggauuuggaucacuaggauuggauugcgaaccacgaacuggcuuagauuuuucagaucuauacuauuuaacaaugaauaacaaacauuggcuaguacauaaagaaugguuccacgauauaccauuaccauggcaugcuggggcagauacuggaacaccacauuggaauaauaaggaagcauuaguagaauuuaaagaugcucacgcaaaaagacaaacaguagucguguuaggaagucaagaaggagcaguacauaccgcauuagcuggugcacuagaagcagaaauggauggagcaaaaggaagauuauuuucuggacaucuaaaaugccgauuaaagauggauaaacuuagauuaaaagguguuagcuacagucuauguacagcagcauucacauucaccaaaguaccugcagagacccuacacggaacaguuaccguagaaguacaauaugcagggacugauggaccaugcaaaguaccugcacaaauggcaguagacaugcaaacauuaaccccaguaggaagauuaauaacagcuaauccaguaauaacagaaucaacagaaaacagcaaaaugaugcuagaauuggacccaccuuuuggagauaguuacauaguaauaggaguaggagauaagaaaauaacacaucacuggcauaggagugguaguacaauuggaaaagcauuugaagcaacaguuagaggagcuaaaagaauggcagucuuaggagauacagcaugggauuuuggaaguguaggagguguuuuuaauucguuaggaaaaggaauacaucaaauauuuggagccgcuuucaaaagucuuuuuggaggaaugucaugguuuucacaaauucuuauagggacauuauuaguuuggcuuggauuaaacacuaaaaacggaaguauaucuuuaacaugccuagcacuaggagggguaaugauuuuucuaaguacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7058 - RNA, 2437 nt, Artificial Sequence
  KU963573.2 prME-short mRNA Design 2 opt
ggggcgcugccuacggagguggcagccaucuccuucucggcaucaagcuuaccaugacgucaauugguauaauaggccuauuacuaacaacagcuauggcggcagaaauuacaagaaggggaucagcauauuauauguaccuagauagaucagaugcagguaaagcuauaaguuuugcuacuacauugggaguaaauaaaugucacguacaaauaauggaucugggucauaugugcgacgcuacaaugucguaugaauguccaaugcuagacgaaggggucgaaccugaugauguagauuguugguguaauacuacaucgacauggguaguauauggcaccugucaucacaaaaaaggagaagcaagaagaucaagaagggcaguaacacuaccaagucauagcacuagaaaauuacaaacaagaagccaaacaugguuagaaagccgagaauauacaaaacauuuaauaaaaguagagaauuggauauuuagaaauccaggauuugccuuaguagcaguugcaauagcauggcuacuuggaucauccacuagucaaaaaguaauauaucuaguaaugauauuauuaauagcaccagcauauaguauuagauguauaggaguuucaaauagagacuuuguugaagguaugucuggaggaacauggguagacguagucuuagaacauggaggauguguaacaguaauggcacaagauaaaccuacaguagauauagaacuaguaacaacaaccguuaguaauauggcagaaguaaggucauauuguuacgaagcaucaauaucugacauggcaagugauagucgaugcccaacacaaggugaagcguauuuggauaaacaaucagauacacaauauguauguaaaagaacucuaguagauagagguuggggcaacggcuguggauuauuuggaaagggaagccuaguaacaugugcaaaauucacuugcaguaaaaaaaugacaggaaaaucaauacaacccgagaaccuagaauauagaauaauguuaucaguacaugggucgcagcacucaggaaugauaggauaugaaacagaugaaaauagggcuaaaguugagguuacgccaaauucuccacgcgcagaagcaacauuagguggauucggcucacuaggacuagauugugagccaagaacaggauuagacuuuagugaucuauauuaucuaacaaugaauaauaaacauugguuaguacauaaagaaugguuucaugacauaccauuaccauggcacgcaggagcugauacaggcacuccgcauuggaauaauaaagaagcacucguagaguuuaaagacgcacacgccaaacgacaaacagugguuguacuaggaucacaagaaggagcaguucacacagcacuagcaggagcacuagaagccgaaauggauggagcuaaagguaaauuauuuaguggacaucugaaaugcagacuaaaaauggacaaacuuagauugaaagguguaaguuauaguuuaugcaccgcagccuuuacuuuuacaaaaguaccagcagaaacacuucauggcacaguaacaguugaaguacaauaugcugguacagauggaccuuguaaaauuccuguacaaauggcagucgacaugcaaacauuaacaccaguuggacgccuaauaacggcuaauccaguaauaacugaaagcacagagaauaguaaaaugauguuagaauuagaucccccauucggagauaguuacauuguaaucggaguuggagauaaaaaaauaacgcaucauuggcacagaagcgguucaacaauaggaaaagcauuugaagcaacagucagaggugcgaaaagaauggcaguccucggcgauacagcaugggauuucgguucagugggaggaguauucaauucucuagggaaagguauacaucaaauauuuggugcagccuuuaaaucauuauuuggaggaaugaguugguuuucccaaauauuaauuggaacauuauuagugugguuagggcucaacacaaaaaacggaaguauaucacuaacuuguuuagcacuaggaggaguaaugauauuuuugucaacugcuguaagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7059 - RNA, 2449 nt, Artificial Sequence
  KX694534.2 prME-short mRNA Design 2 opt
ggggcgcugccuacggagguggcagccaucuccuucucggcaucaagcuuaccaugacaagcguaggaauaguaggucuauuacuaacgacagcaauggcagcagaaguaacuagaagaggaucggcauauuauauguauuuagacagaaaugaugcgggggaagcaauaucuuuuccgacaacauuaggaaugaauaaauguuauauacaaaucauggaccuuggacauaugugugacgcgacaaugucauaugaauguccaauguuggaugaaggaguagaaccagaugauguugauuguugguguaacacgacaucuacauggguaguauauggcacuugccaucauaaaaaaggagaagcgagaagaagcagaagagcagugacacuaccuagucauucaacaagaaaauuacaaacaagaucacaaacaugguuagaaucaagagaauacacaaaacacuuaauucgaguugaaaacuggauauucagaaacccaggauuugccuuagcugcugcagcaauagcaugguuauuaggcaguaguacaagccaaaaaguaauauaucuaguaaugauccuauuaauagccccagcauauaguauaagauguauugguguaucuaaucgagauuuuguagaaggaaugucaggaggaacauggguagacguaguauuagaacacggaggaugugucacaguaauggcacaagacaaaccaacaguagauauugaauuagucacaacuacaguaagcaauauggcagaaguaagaaguuauuguuaugaagccuccauaucagauauggcaagugacucaagauguccgacucaaggagaagcuuaucuugauaaacaaagcgauacucaguacguaugcaaaagaacacuuguugauagaggcuggggaaacggaugcggauuauucggaaaaggaagccugguaacaugcgcuaaauuugcauguaguaaaaaaaugacaggaaaaagcauacaaccagaaaaucuagaauaucgaauaauguuaucaguacacggcucacagcauucaggaaugauuguuaacgacacaggacacgaaacugacgagaauagagcaaaaguugaaauaacaccaaacucaccgagagcagaagcaacauuaggaggcuucggcagccuaggacuagacugugaaccacgaacaggcuuagacuuuagugaucuauauuaccucacuaugaauaacaaacauugguuaguucacaaagaaugguuccaugauauaccuuuaccauggcaugcaggugccgauacugguacaccacacuggaacaacaaagaagcauuaguagaauuuaaagaugcacaugcaaaaagacaaacaguuguuguauuaggaucacaagaaggagcaguacacacagcguuagcaggggcacuagaagcagaaauggacggggccaaaggacggcuaaguucaggacauuuaaaauguagauuaaaaauggauaaauuaagacuaaaaggaguaucguacucgcugugcacagcagccuuuacauucacaaaaauuccugccgaaacacuacacggaacuguaacaguagagguacaauacgcagguacugauggaccauguaaaguaccagcgcaaauggcaguagauaugcaaacauugacaccaguaggaagauuaauaacagcaaauccaguaauaacagaaucuacagaaaacucaaaaaugaugcuugaauuagauccaccuuuuggagauaguuacauaguaauagggguaggagaaaaaaagauaacccaccauuggcauagaucaggaucaaccauagggaaagcauuugaagccacugucagaggagcuaaaaggauggcaguuuuaggagacacagcaugggauuucggaagcguggguggcgcacucaauagucuuggacgaggaauacaucaaauauuuggugccgcauucaaaagucuuuuuggaggaaugaguugguuuucucagauacuaauuggaacauuauuaauguggcuaggauuaaauacaaaaaauggaaguauuucauugauguguuuagcacuaggaggaguauuaauauuucuaaguacggcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7060 - RNA, 2449 nt, Artificial Sequence
  KX369547.1 prME-short mRNA Design 2 opt
ggggcgcugccuacggagguggcagccaucuccuucucggcaucaagcuuaccaugacaagugucggaauagugggauuacuuuuaacaacagcaauggcugcugaaguaacuagaagagguucagcauacuacauguacuuagacagaaaugaugcaggagaagcaauaaguuuuccgacaacauugggaaugaauaaauguuauauacaaauaauggauuuaggacauaugugugaugcaacaaugucauaugaaugucccauguuagacgaaggcguagaaccagaugauguggauugcuggugcaauacaacaucaacuuggguagucuacggaacaugucaucacaagaaaggugaagcaagaagaagcagacgagcaguaacauuaccuagucauagcacuagaaaguuacaaacacggagucaaacuugguuagagaguagggaauauacaaagcauuuaauaagaguagaaaacuggauauucagaaauccaggucuagcucuagcugcagcugcaauugcauggcuauuaggaucaaguaccucacaaaaagugauauauuuaguaaugauuuuacuaaucgcaccagcauauucaauaagaugcauaggaguuagcaaucgagauuucguagaaggaaugaguggaggaacauggguagauguuguauuagaacacgguggauguguuacagugauggcgcaagauaaaccuacaguagauauagaauuaguuacaacaacuguuagcaauauggcggaaguaagaaguuauuguuacgaagccaguauaagugauauggcaucggacaguagaugccccacacaaggugaagcauaucuagauaaacaaucagauacacaauauguuugcaaaagaacauuaguagacagagguuggggaaaugguugcggucuuuuuggaaaagguagucuaguaacaugcgcaaaauucgccuguagcaagaaaaugacagguaaaaguauacagccugaaaacuuagaguauagaauaaugcuaucaguacacgggagccaacacagcggaaugauuguuaacgacacgggacaugaaacagaugaaaacagagcaaaaguagaaauuacaccgaauagcccucgagcagaagccacacuaggugguuuuggaagccuaggauuggacugugaaccaaggacaggucuagauuuuagugaucuauauuacuuaacaaugaacaauaaacauugguuaguacauaaagaaugguuucaugacaucccuuuaccauggcaugcaggagcagauaccggaacuccacauuggaacaauaaagaagcauuaguagaauuuaaagaugcacacgcaaagagacaaacaguaguaguauuaggaagccaagaaggagccguacauacagccuuagcaggcgcguuagaagcagaaauggauggagcaaaggguagauuaaguucgggacauuugaaauguaggcucaaaauggauaaauuacgauugaaaggaguaaguuacucuuuguguacagcagcuuuuacuuuuacaaaaauaccagcagaaacauuacaugguacagucacuguggaaguacaauaugcaggaacagauggaccaugcaaaguaccugcacaaauggcaguagacaugcaaacacuuacaccgguagguagauuaauaacagcuaauccaguaauaaccgaaaguacagaaaacagcaaaaugauguuagaauuagacccgccauuuggagauucauauauaguaauuggaguaggagaaaagaaaauaacacaccauuggcauagaucaggaaguacuauagguaaagcguucgaagcuacaguaagaggagcaaaaagaauggccguguugggcgacacugcaugggacuuuggaucgguuggaggugcacuaaauucauuagguaaaggcauucaccaaauauuuggagcagcauuuaagucauuauuuggaggaaugagcugguuuucacaaauacuaauuggaacguuauuaauguggcuaggauuaaauacuaaaaaugguagcauuaguuuaaugugucuagccuugggaggaguguuaaucuuccuuaguacagcaguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7061 - RNA, 2449 nt, Artificial Sequence
  KX447515.1 prME-short mRNA Design 2 opt
ggggcgcugccuacggagguggcagccaucuccuucucggcaucaagcuuaccaugacaucaguagguaucguaggauuacuauuaacaacagcaauggcagcagaaguuacgagaagagguucagccuacuauauguaucuugauaggaacgaugcaggggaagcuaucaguuuuccuacaacauuaggaaugaacaaaugcuauauucaaauaauggauuuaggacauaugugugacgcuacuaugagcuaugaauguccuaugcuagacgaaggcguagaaccugaugacguagacuguugguguaauacaacaucgaccuggguaguguauggaacgugucaucauaagaaaggagaagcaagaagaagcagacgagcuguaacauuaccaucacauaguacaagaaaauuacaaacacgaucacaaacauggcuagaaaguagagaauauacaaaacauuuaauuagaguugaaaauuggauauuuaggaauccagguuuugcauuggcagcagcugcaauugcguggcugcucggcaguucaacaucacaaaaaguaauauaucuaguaaugauauugcuaauagcuccagcuuauucaauaagaugcauaggaguuucaaauagagacuuuguugaaggcaugaguggaggcacauggguagacguaguauuagaacacggaggaugcgugacuguaauggcacaagauaaaccaacaguagauauugaguugguaacaacaacagugucaaauauggcagaaguaagaaguuauuguuacgaagcuagcauaagugauauggcaucagacagcagauguccuacucaaggcgaagcauaucucgacaaacaaagugauacacaauacguauguaaaaggacacuggucgacagaggguggggaaacggcugugguuuguuuggaaaaggaagucuaguaaccugugcaaaauuugcuuguaguaaaaagaugacgggaaagaguauccaaccagaaaacuuggaauauagaauaauguuauccgugcacgggagucaacauucaggaaugauaguaaacgauacaggacaugaaacagacgaaaauagagcaaaaguggaaauuacuccaaauaguccaagggccgaagcuacucuuggcggauuuggaucauuaggauuagacugcgaaccgaggacaggacuagauuucagugauuuguacuaucuaacaaugaacaacaaacauugguuaguccauaaagaaugguuccaugauauuccauuaccguggcaugcuggugcggauacuggaacaccacauuggaauaauaaagaagcauuaguagaauuuaaagaugcucaugcaaaaagacaaaccguaguaguuuuagguagucaagaaggagcaguacacacagcauuggcgggagcccuagaagcagaaauggauggagcaaaagggagacuaucuucaggacacuugaaauguagauugaaaauggauaaacucagauuaaaagggguaucauauucauuauguacagcugcauucacauuuacaaaaauaccagcugaaacacuacaugguacuguuacgguagaaguacaauaugcaggcacagacggaccuuguaaaguuccagcacaaauggcaguagacaugcaaacauuaacaccuguaggaagauuaauaacagcaaauccagugauaacagaaucaacagaaaauaguaaaaugauguuagaauuagauccaccauuuggcgauucauauauaguaauagguguaggagaaaagaaaaucacccaccauugguauagaagcggaagcacaauagguaaagcauuugaagcaacaguaagaggagcaaaaaggauggccguucuaggagacacugcaugggauuuuggaaguguaggaggagcacuaaacucuuuaggaaaagguauucaucaaauauuuggagcagcauuuaaaucguuauucggaggaaugagcugguuuucacaaaucuuaauaggaacauuacuaauguggcuuggauugaauaccaaaaauggaucgauaucuuuaaugugucuagcacuagggggaguuuuaauauuucuaucaacagcagugagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7062 - RNA, 2449 nt, Artificial Sequence
  KU729218.1 prME-short mRNA Design 2 opt
ggggcgcugccuacggagguggcagccaucuccuucucggcaucaagcuuaccaugacgucuguuggaauaguuggauuauuacuaacaacagcaauggcagcagaaguuacaagaagaggcucagccuauuacauguacuuagauagaaaugacgcaggagaagcuauuagcuuuccgacuacucuaggaaugaauaaaugcuacauacaaauaauggacuuaggacacaugugcgaugcaacaaugaguuacgaauguccaaugcuagacgaggguguugaaccggaugauguagauuguugguguaacaccacaagcacuugggugguauauggaacgugucaccacaaaaaaggagaagcacguagaucacgaagggcaguaacacucccaucacauaguacuagaaaauuacaaacaagaagucaaacgugguuagaaucaagagaauacaccaaacacuuaauuagaguagaaaauuggauauuucgaaauccagguuuugcucuagcagcagcagcaauagcaugguuauuaggaagcucgacaagucaaaaaguaauauauuuaguaaugauacuauuaauagcuccggcuuauucaauaagauguauaggaguaucaaauagagacuuuguagaaggaaugucuggaggaacuuggguugaugugguauuagaacaugggggauguguaacaguaauggcccaagauaaaccaacaguugauauagaacuuguuacaacaaccguaaguaacauggccgaaguaagauccuauugcuaugaagcaucaauaucggauauggcaagugauucaagauguccuacucaaggagaagccuacuuagacaaacaaagcgauacacaauauguaugcaaaaggacacuaguagaucgugguuggggaaacggauguggauuguucggaaaagguagccucguaacaugugcaaaauuugcuuguaguaaaaaaaugacaggaaaaucaauacaacccgaaaauuuagaauauagaauaaugcuaaguguccacgggagccaacauagcgguaugauaguuaacgauacaggacaugaaacugaugaaaauagggcaaaagucgaaauaacaccaaauaguccaagagcagaagcaacauuagguggauuuggaucuuuaggacuagacugugaaccaaggacugguuuagauuuuagcgacuuauauuaucuaacaaugaacaauaaacauugguuaguacauaaagaaugguuccaugauauaccauuaccauggcacgcaggagcagauaccgguaccccgcacuggaauaauaaagaagcacuaguugaauuuaaagacgcacaugcaaaacgucagacaguaguaguauuaggaagucaagaaggcgcaguacauacagcauuagcaggagcacuugaagcggaaauggauggugcaaaaggaagauuaaguucaggacauuugaagugucgguuaaaaauggacaaacuaagauuaaaaggaguaucauauucgcuauguacagcugcuuuuacauucacuaaaaucccagcugaaacacuacauggaacaguaacaguagaaguucaauaugcagguacugacggaccaugcaaagucccagcacaaauggcaguggauacacagaccuuaacacccgugggaagacuuauuacugcaaauccaguaauaacugaaucaacugaaaauucaaaaaugauguuagaauuagauccaccauuuggagacucguauaucguaauugguguaggagaaaaaaaaauaacucaucacuggcauagaucaggaucaacaauaggaaaagcauucgaagcuacaguaagaggcgcaaaaagaauggcaguccuaggagauacugcaugggacuucggaagcguaggaggcgcacuuaauucucuagguaaaggaauacaucaaauauuuggagcagcauuuaaaagcuuauuuggaggaauguccugguuuucacaaauacuaauaggaacuuuguuaauguggcuuggucuuaauacaaaaaaugggucaauaaguuuaaugugccuagcuuuaggaggggucuuaauauuucuuuccacugcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7063 - RNA, 2449 nt, Artificial Sequence
  KU501217.1 prME-short mRNA Design 2 opt
ggggcgcugccuacggagguggcagccaucuccuucucggcaucaagcuuaccaugacaucaguuggcauuguaggauuacuauuaacaacagcuauggcagcagaaguaacacgaaggggaucagcauauuauauguaucuagauagaaacgaugcaggagaagcaaucagcuucccaacaacacuagggaugaauaaauguuauauacaaauuauggauuugggccacaugugugacgcaacaaugaguuaugaaugcccaaugcuugacgaaggaguugaacccgaugauguagacugcugguguaauacaaccucaacuuggguaguuuauggaaccugucaucacaagaaaggagaagcucgaagaucaagacgagcaguaacauuaccuagucauucaacgagaaaauuacaaacuagaucacaaacuuggcuugaauccagagaauacacaaaacaucuaauaagaguugaaaacuggaucuuuagaaacccugguuuugccuuagcagcggcugcaauagcaugguuacuaggaucaucaacaagucagaaagucauauauuuagucaugauauuacuaauagcuccugcauacucuauaagauguauaggugugaguaauagagacuuuguggaaggaaugucugguggaacauggguggacguaguuuuagagcacgggggaugcguuacaguaauggcccaagauaaaccaacaguugauauugagcuaguaacaacgaccguaagcaauauggcagaaauaagaucauauugcuaugaagccucaauuagugacauggcuagcgauagcagaugcccaacacagggagaagcauaccuggacaaacaaucagacacacaauauguaugcaaaagaacauuaguagacagaggauggggaaaugguuguggacuauuuggaaaagggucauuaguaacaugcgcaaaauuugcauguucaaagaaaaugaccgguaaaucaauacaaccagaaaauuuagaauacagaauaaugcuaucaguacacgguagucaacauagcgggaugauuguaaacgauacaggacacgaaacagaugaaaaucgcgcaaaaguagaaauaacgccaaauaguccuagagcugaagcaacauuggguggauuugggaguuuaggacuagauugcgaaccuagaacaggacuagauuuuagugacuuauauuaucucacaaugaauaauaaacacugguuaguucacaaagaaugguuucaugauauaccauuaccauggcaugcaggagcagauacagguacaccccauuggaacaauaaagaagcucuaguagaguuuaaagacgcacaugcaaaacgacaaacaguaguaguuuuagguagucaagaaggcgcagugcauacagcacuagcaggagcauuagaagcagaaauggacggugcgaaaggucgauuaaguaguggacauuuaaaaugccgacuaaaaauggacaaauuacgauuaaaagguguaucauacucauuauguaccgcugcauucacuuuuacaaaaauaccugcagaaacauugcacggaacuguaacaguagaaguacaauaugcggguacagauggaccaugcaaaguuccagcccaaauggcuguggauaugcaaacacuaacaccaguagguagacuuauaacggcaaauccaguaauaacagaaaguacagaaaauucaaaaaugauguuagaauuagaucccccauuuggagacagcuauauaguuauaggaguaggagagaaaaagauaacucaucauuggcaucgaagcgguucaacaauuggaaaagcauuugaagcaacuguaagaggagcaaaaagaauggccgucuuaggggacacugcuugggauuucggaucaguaggcggugcauuaaauucacuaggaaaagguauucaccaaauauuuggagcagcauucaaaucauuauucggaggcaugaguugguucagucaaauacuaauaggaacauuacuaauguggcuuggacuaaacacuaaaaaugguucaauaaguuuaaugugucuugcauuaggcggcguacuuauauuuuuaucaacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7064 - RNA, 2449 nt, Artificial Sequence
  KU312314.1 prME-short mRNA Design 2 opt
ggggcgcugccuacggagguggcagccaucuccuucucggcaucaagcuuaccaugaccucaguagguauaguuggauuacuacuaacaaccgcaauggcugcagaaguaacaagaagaggaucagcauauuauauguauuuagacagaaacgaugcaggggaagcgauaucuuuuccaacaacuuuagggaugaauaaauguuacauacaaauaauggaccuaggucacaugugugaugcaacuaugucauaugaaugcccaaugcucgaugaaggaguagaaccagacgacguagacuguugguguaauacaacuucaacauggguaguauauggcacaugccaucauaagaaaggagaagcaagaagaucacguagagcaguaacauugccaucacauucuaccagaaaacuacaaacaagaagccaaacaugguuagaaucaagagaauacacaaaacacuuaauaagaguagaaaauuggauuuuuagaaacccagguuucgcuuuagcugcagcagcuauagcuuggcuauuagggaguagcacaucacaaaaagucauauaucuaguuaugauccuccugauagcaccagcauauaguauacgauguauaggaguaucaaacagggacuucguugaaggaaugaguggaggaacuuggguagauguuguucuagagcauggaggcuguguaacuguaauggcacaagacaaaccaacaguagacauagagcuaguaacaacuacuguaagcaauauggcugaaguaagaucuuauugcuaugaagcaagcauaucagauauggcaagugacagucgauguccaacccaaggagaggcuuauuuagauaaacaauccgauacucaauauguuuguaaacgaacccuaguggacagaggaugggguaacggauguggacuauuugggaaaggaagccucgugacaugugcaaaauuugcuuguucgaaaaagaugacaggaaaaucaauacaaccugaaaaucuagaauauagaauaaugcuaucuguacacggaagccaacauaguggaaugauaguaaaugacacaggucaugaaacagacgagaacagagcaaaaguugaaauuacgcccaauagcccucgagcagaagcuacacuagggggauuugguucucuaggacuagacugugaaccaagaacaggccuagauuuuucagaccuauauuauuuaacaaugaauaauaaacacuggcuaguccauaaagaaugguuccacgauauaccauuacccuggcacgccggagcagacacaggaacaccucacuggaauaauaaagaagcccuuguagaauuuaaagaugcacacgcaaaacgucaaaccguaguaguauuaggcagucaagaaggagcaguucauacagcauuagcuggagcauuagaagcagaaauggacggagcaaagggcagacuauccucaggacaucuaaaaugcagauugaaaauggauaaacuacgauuaaaaggaguaaguuauucacuguguacagcagcauuuacguuuacaaaaauaccagcagaaacauuacacggaacagucacaguagaaguucaauaugcaggaacagacgguccauguaaaguauuagcacaaauggcuguagauaugcaaacacuaacaccuguaggaagauuaauuacugcaaauccuguuaucacugaaagcacagaaaacucaaaaaugaugcuugaauuagauccaccauuuggcgauucauacaucgucauuggaguaggagaaaagaaaauaacgcaucacuggcaccgaaguggaucaacaauagguaaagcauuugaagcaacaguacguggagcuaaaagaauggcaguuuuaggagauacagcuugggauuuuggaagugucgguggagcacuaaacucacuaggaaaaggaauacaucaaauauuuggagcagcauucaaaucauuauuuggaggcaugucaugguuuagucaaauuuuaauaggaacucuacuaaugugguuaggauuaaacacuaaaaacgguucaauauccuuaaugugucuagccuuaggaggaguucuuauauuucucagcacagcuguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7065 - RNA, 2449 nt, Artificial Sequence
  KX446950.2 prME-short mRNA Design 2 opt
ggggcgcugccuacggagguggcagccaucuccuucucggcaucaagcuuaccaugacgaguguaggaauaguaggauuguugcuaacaacagcuauggcugcagaaguaacuagaagaggcagugccuacuacauguacuuagacagaaaugacgcuggugaagcaauuagcuuuccaacaacacuaggaaugaacaaauguuauauacaaauaauggacuuaggccauaugugugaugcaaccaugucauacgaguguccaacauuagacgagggcguugaaccagacgacguagauugcugguguaauaccacuucaacauggguaguauaugguacuugucaccauaagaaaggugaagcaagaagaucacguagagcagugaccuuaccuucacauucuacaagaaaauuacaaacaaggagucaaacauggcuugaaucaagagaguauacaaaacaccuaauaaggguugaaaauuggauauuucgaaacccgggguuugcacuagccgcagcugcaauagcauggcuccuaggaaguucaacuagccaaaaaguaauauaccuaguaaugaucuugcuuauagccccagcauacaguauaagauguauuggagugaguaauagagauuucguagaaggaaugucaggagggacuuggguugauguaguauuagaacauggaggaugcguaaccguaauggcacaagauaaaccgacgguugauauagaauuaguaaccacaacaguaaguaauauggcugagguaagaaguuacuguuaugaggcaucaauaucagacauggccagcgacagucguuguccaacgcaaggagaagccuauuuagacaaacaaucagauacacaauauguauguaaaagaacucuaguugauagaggauggggaaacggcugcggacuuuuuggaaaaggaucauuagugacaugcgcaaaauuugccuguaguaagaaaaugacagguaaaucuauacaaccugaaaauuuagaauauagaauuauguuaucaguacacggaucacaacauucggggaugauaguaaaugauaccggacacgaaacagaugaaaauagagcuaaaguugaaaucacaccaaacaguccaagagcagaagcaacauuaggcggauucggaucacuaggccuagauugugaaccaagaacaggacuagauuuuagcgaucuuuauuacuuaacaaugaauaauaaacauugguuaguucauaaagaaugguuucaugauauaccccuuccauggcaugccggagcagauacuggaacaccacacuggaauaacaaagaagcauuagucgaauuuaaggaugcacaugcaaaaagacaaacuguuguaguauuaggaucacaagaaggagcaguacauacagcuuuagcuggagcacuagaagcugaaauggacggagcaaaaggacgauuaagcucuggacaccuaaaauguagacuaaaaauggauaaacuaagacucaaaggaguuucuuauucguuauguacugcagcauuuacuuuuacaaaaauuccagcagaaacgcuacauggaacaguaacuguagaaguacaauaugccggaacugauggaccauguaaagucccagcacaaauggcaguugauaugcaaacacuaacuccaguaggaagauuaauaaccgcuaauccagucauaacagaaucaacagaaaauucaaaaaugauguuagaauuggauccucccuuuggugacaguuacauaguaauaggaguaggagaaaagaaaauaacacaucacuggcauagaaguggaucaacuauagguaaagcauuugaagcuacaguacgaggagcaaaaagaauggccguucuuggagacacagcuugggacuuuggaaguguaggaggagcucuaaauagcuuaggaaaggguauacaucaaauauuuggagccgcuuuuaaaagucuauucggaggaaugucaugguuuucacaaauauuaauaggaacacuacuaaugugguuaggacuaaauacgaaaaauggcagcauuagcuuaauguguuuagcacuaggaggaguucuaauauucuuaucaacagccguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7066 - RNA, 2449 nt, Artificial Sequence
  KY003157.1 prME-short mRNA Design 2 opt
ggggcgcugccuacggagguggcagccaucuccuucucggcaucaagcuuaccaugacaucaguaggaauagugggauuacuuuuaacaacggcaauggcagcugaaguaacaagaagaggcagugcuuauuauauguauuuagacaggaaugaugcaggugaagcaauuaguuuuccuacaacuuuaggcaugaacaaauguuacauacaaauaauggaucuaggacauaugugcgaugcaacaaugucauaugagugcccuauguuagaugaagguguugaaccagacgauguggauugcugguguaauaccaccagcacuuggguaguauacggaacaugucaucauaaaaaaggcgaagcaagaagaaguaggagagcuguaacucucccuagucauucuacgagaaaauuacaaacaagaucacaaacuuggcuugaaucaagagaauauacaaaacauuuaauacgaguagaaaacuggauauuuagaaauccagguuucgcacuggcagcagcagcaauagcaugguuacuaggaucaucaacaagccaaaaaguaauauacuuaguaaugauucuguuaauagcaccagcguauagcauccguuguauagguguaucaaauagagauuuugucgaaggaaugaguggaggaacauggguugauguaguucuagaacacggaggcugcgucacagucauggcacaagauaaaccaacgguagauauugaauuaguaacaacaaccgucagcaacauggcagaaguaagaucauacuguuaugaagcaucaauauccgauauggcaucagacucuagauguccaacucagggagaggcauauuuagauaaacaaucagauacgcaauauguauguaaaagaacauuaguagauagaggguggggcaauggauguggauuauuuggaaagggaucuuuaguuacuugugcaaaauuugcaugcucaaaaaaaaugacaggaaaaaguauucaaccagaaaauuuagaauaccgaauaaugcuuaguguacacggaagucaacauucaggaaugaucgucaaugacacagggcacgaaacagacgaaaacagagcaaaaguagaaauaacaccuaauucuccaagagcagaagcaacuuuagguggauucggaagcuugggccuugauugugaaccaagaaccgggcuugauuuuagcgauuuauacuauuuaacaaugaauaauaaacauugguuaguacauaaagaaugguuccaugauauaccucuaccauggcacgcaggugcagauacaggaacaccacacuggaacaauaaagaagccuuaguugaauuuaaagaugcacaugcgaaaagacaaacagucgucguacuaggaagucaagaaggagcaguacauacugcucuugcaggggccuuagaagcagagauggauggagcaaaaggaagauuaucuucgggacaucucaaauguagauuaaaaauggauaaauuaagacuaaaaggugucuccuacagucuauguacggcagcauucacauuuacaaaaauaccugcagaaaccuuacauggaacaguaacagucgaaguacaauaugcaggaacagaugguccauguaaaguaccagcacaaauggcaguugauaugcagacauuaacacccguaggaagauuaauaacagcaaauccagucauaacugaaucaacagaaaacaguaaaaugauguuagaauuagauccgccauucggagauaguuauauaguuauuggagucggugaaaaaaaaauaacucaccauuggcacagaucaggaucaacaauaggaaaagcauuugaagcaacaguaagaggagcaaaaagaauggcaguguuaggagauacugcaugggauuuuggaaguguaggaggagccuugaauucauuagguaaagguauacaccaaauauuuggggccgcauuuaaaagcuuauuuggaggaaugaguugguuuucacaaauucuaauaggaacauuauuaauguggcuuggauuaaauacuaaaaacgguucuauuucacuaauguguuuagcauuaggcgggguucuaauauuucuuucuacggucguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7067 - RNA, 2449 nt, Artificial Sequence
  KX811222.1 prME-short mRNA Design 2 opt
ggggcgcugccuacggagguggcagccaucuccuucucggcaucaagcuuaccaugacaucaguugguauaguuggacuacuauuaacaacagcgauggcagcugaaguaacaagaagaggaucagcauauuacauguacuuagauaggaacgaugcuggugaagcaauuucauuuccuacaacacuaggaaugaauaaauguuauauacaaauaauggaccuaggucauaugugcgaugcuacuaugucuuaugaaugcccaaugcuagaugaaggaguagaaccagaugauguagacuguugguguaacacaaccagugcauggguaguauaugguaccugccaucacaagaaaggagaagcuagaagaucuagacgagcuguaacauuaccuagccauucaacgagaaaauuacagacaagaccacaaacuuggcuagaaucuagagaauacaccaaacaucuaauaaggguagaaaauuggauauuuagaaauccagguuuugcacuagcugccgcagcaauugcuugguuacuagguucaucaacaucucaaaaaguaaucuaucuaguuaugaucuuacuaauagcuccugcauauaguauaagaugcauaggaguaagcaacagagauuuuguagaagguaugucagguggaacauggguugauguaguacuugaacacgguggaugugugacuguaauggcacaggauaaacccacaguggacauagaauuaguaacaacaacugugucaaauauggcugaaguaagaucauacugcuaugaagcaucaauuagugauauggcauccgauaguagauguccuacacaaggagaagcauaucuagauaaacaaagugacacacaauaugucuguaaaagaacguuaguugauagaggauggggaaauggaugcggauuauuuggaaaaggaucacuuguaaccugugcaaaauuugcauguucaaagaaaaugacaggcaaaaguauacaaccagaaaaucuagaauauagaauaauguuaucgguccauggaucacaacauagcgguaugauuguaaaugauacaggacacgaaacagacgaaaauagggcaaaaguugaaaucaccccaaacucacccagagcagaagcaacucugggaggauuuggcagccugggauuagauugugaaccaagaacuggacuugauuuuagugaucuauacuaucuuacaaugaacaauaaacauuggcucguacauaaagaaugguuccaugauauaccauuaccuuggcaugcaggagccgauacaggaacaccacacuggaacaauaaagaagcauuaguagaguucaaagacgcacaugcaaaaaggcaaacaguaguuguacuaggaagccaagaaggagcaguucauacugcauuagcgggugcauuagaagccgaaauggauggagcgaaagguagauuaucuucuggacacuugaaaugucgcuuaaaaauggauaaacuaagacuaaaaggaguaaguuacucauuaugcacagcagcauucacauuuacaaaaauuccugcggaaacacuacacggaacuguaacaguagaaguacaauaugcuggaacugauggaccauguaaaguucccgcacaaauggcaguugacaugcaaacauuaacaccgguaggaagauugauuacugcgaacccuguuauaacagaaaguacggaaaauaguaaaaugaugcuagaauuagauccaccuuuuggagauaguuauauaguaauaggaguaggugaaaagaaaauaacacaucauuggcacagaagcggaucaacaauaggaaaagcauuugaagcuacaguuagaggagcuaaacgaauggccguacuuggagacacagccugggauuuuggcuccguaggaggagcauuaaacagucuagguaaaggcauacaucaaauauuuggagcagccuuuaaaaguuuauuuggagguaugucaugguuuucacaaauacuaauaggaacauuauuaauguggcuaggacuaaacacuaaaaauggaucgauaagccuuaugugcuuagcacuaggagguguuuuaauauuucuaagcacagcagugucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7068 - RNA, 2449 nt, Artificial Sequence
  KX447516.1 prME-short mRNA Design 2 opt
ggggcgcugccuacggagguggcagccaucuccuucucggcaucaagcuuaccaugacaucugugggaauaguagguuuauuauuaacuaccgcaauggcugccgaaguaacaagaagaggaucagcauauuauauguaccuugauagaaaugaugcaggagaagcaauaucuuuuccaacaacauuagguaugaauaaaugcuacauacaaauuauggauuuaggacauaugugugaugcaacgaugucauaugaauguccaaugcuugaugaaggaguugaaccugacgauguagauuguugguguaauacaacaagcaccuggguuguauauggaacaugucaucauaaaaaaggagaagcucgaagaaguagaagagcaguaacccuaccgagccacagcacuagaaaauuacaaacuaggucacaaaccuggcuagaaaguagagaauacacaaaacaucuuauaagaguagaaaauuggaucuuuagaaauccagguuucgcacuagcagcagcagcaauagcauggcuacuagguucguccacaucaaaaaaaguaauauauuuaguaaugauauuacuaauagcaccagcauauucaauaagauguauagguguaaguaauagagauuucguugaaggaaugaguggaggaacauggguagauguagucuuagaacacggaggaugugugacuguuauggcacaagacaaaccaacaguagacauagaacuuguaacgacaacaguaagcaauauggcagaaguacguaguuauugcuaugaagcaucaauuucagauauggcaucagauuccagauguccaacacaaggagaagcuuauuuagauaaacagucagauacgcaauauguuugcaaacgaacccuaguugacagaggguggggcaacggaugcggauuguucggaaaaggaucguuaguaacuugugccaaauucgcauguucuaaaaaaaugaccggaaaaucaauacaaccagaaaauuuagaauauagaaucaugcuaagcgugcauggcucacaacacucuggcaugauuguaaaugauacaggacaugaaacugacgagaauagagcuaaaguagaaauaacaccgaauucacccagagcagaagcaacauuaggaggauucggaucacugggauuagauugcgaaccacgaacaggauuagauuucagugaccuuuauuauuuaacaaugaauaauaaacauugguuaguacauaaagaaugguuccacgacauaccauuaccuuggcaugcaggcgccgauacaggaacaccacauuggaauaauaaagaagcucuaguagaauuuaaagaugcacaugcaaaaaggcaaacaguagucguucuaggaucacaagaaggagcaguacauacagcauuagcaggagccuuagaagccgaaauggauggcgcaaaaggaagacuaagcagcggacauuugaaaugucgguuaaagauggacaaguuaagguuaaaaggcguuagcuacaguuuauguacagcagcauuuaccuucacaaaaaucccugccgaaacauuacauggaacaguuacaguagaaguucaauaugccgggacugacggaccauguaaaguaccagcucaaauggcaguagacaugcaaacauuaacaccuguuggaagacuaauaacagcaaauccagugauaacugagaguacagaaaacaguaaaaugauguuagaauuggacccuccauucggugacagcuauaucguaauaggaguaggugaaaaaaaaauaacacaucacuggcacagaucaggaucaacaauagguaaagcauucgaagcaacaguacguggagcaaaacgaauggcgguucuaggagauacugcgugggauuucggaagcgucggaggggcauuaaacucauuagggaaaggaauucaucaaauauuuggugccgcauuuaaaagccuauuuggagguaugaguugguuuagucaaauauuaauuggaacacuccuuauguggcucggauuaaauacuaaaaacggaucuauuaguuuaauguguuuggcauuaggugguguacuuauauuuuuaaguacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7069 - RNA, 2449 nt, Artificial Sequence
  KX520666.1 prME-short mRNA Design 2 opt
ggggcgcugccuacggagguggcagccaucuccuucucggcaucaagcuuaccaugacgaguguagguauaguaggauuauuacuaaccacagcuauggccgcagaaguaaccagaagaggaagugcauacuauauguacuuagaucggaaugaugcaggggaagccauaagcuuuccaacaacucuagguaugaauaaaugcuauauacaaauaauggacuuaggacauaugugugaugcgacaaugagcuaugaauguccaaugcuagacgaaggcguagaaccagaugauguugacugcugguguaacacaacaaguacauggguaguauacgggacaugucaccauaaaaaaggcgaagcgcgaagaucaagaagagcaguuacauuaccaagucauuccacuagaaaauuacaaacccguucacaaacauggcuugaaucacgagaauacacaaaacaucuuauucguguagaaaacuggauauuccgaaauccgggauuugcacuagcagcagcagcaaucgcaugguuauuaggaaguucuacaagacaaaaaguuauauaccucguaaugauacuuuuaauagcaccagccuauagcauaagauguauaggaguauccaacagagauuucguugaaggaaugaguggaggaacauggguagacguagucuuagaacauggaggauguguaacaguaauggcucaagauaaaccuacaguugauauagaacucguaacaacuacaguaaguaauauggccgaaguccguucauauuguuaugaagcaucaauaucagauauggcgagcgacaguagauguccuacccaaggagaagcauauuuagacaaacaaagugauacacaauaugucugcaaaagaacauuaguggacagagguugggguaauggaugcggacuauucggaaaaggaaguuuaguaacaugugccaaauuugccuguucaaagaaaaugacaggaaaaucaauacaaccagaaaacuuagaauauagaauuauguuaucaguccauggcucacaacacagugggaugauagucaacgacacaggacaugaaacagaugaaaauagagcuaaaguagaaauuacaccaaauucaccccgagcggaagcaacacuaggaggauuuggaucacuaggauuagauugugaaccuagaacagguuuagacuuuagugauuuauacuaucuuacaaugaacaauaaacacugguuaguacacaaagagugguuccaugacauaccacuuccauggcaugcaggagcagacacggggacgccacauuggaauaauaaagaagcauuaguagaauuuaaagaugcacaugcgaaaagacaaacgguaguaguacuagguagccaagaaggagcaguacacacagccuuagcaggugcauuagaagcagaaauggacggagcuaaaggacgguuaucaagugggcacuuaaaaugcagacuaaaaauggacaaauuaagauuaaaaggaguaagcuacucauuaugcacagcagcauuuacauucacuaaaauccccgcagagacuuuacauggcacagugaccguagaaguacaauacgcaggcacagauggaccauguaaaguuccugcacaaauggcuguagauaugcaaacguuaacaccaguugguagauuaauaacugcaaauccuguaauuaccgaguccacggaaaauucaaaaaugaugcuagaauuagacccaccauuuggagauucuuauauaguaauaggagucggagagaagaaaauaacucaucauuggcauagaagcggaaguacaauaggaaaagcauuugaagcaacagucagaggagccaaaagaauggcaguucuaggagacaccgcuugggauuuuggaucaguaggaggugccuuaaauucucuaggaaaaggaauacaucagauauuuggugcagcauuuaaaaguuuauucgguggaaugucgugguuuucacagaucuuaauaggaacgcugcuaauguggcuaggacuaaauacaaaaaauggaucaauaucauuaaugugucuagcauuagguggcguacuaauauuuuuaucaacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7070 - RNA, 2449 nt, Artificial Sequence
  KU497555.1 prME-short mRNA Design 2 opt
ggggcgcugccuacggagguggcagccaucuccuucucggcaucaagcuuaccaugacaagugucggcauaguaggucucuuacugacaacagcgauggcagcagaaguaacaagaagaggcagugcauacuacauguauuuagauaggaaugaugccggggaagcaauaucauucccaacaacuuuagguaugaauaaauguuauauacaaauaauggauuuggggcauaugugugacgcuaccaugaguuacgaauguccaaugcuugaugaaggugucgaaccagaugauguagauuguugguguaauacaacuaguacauggguaguuuauggaacuugucaucacaaaaaaggagaagcgagaagaagcagaagagcugugacacuccccucccauaguacuagaaaacuacaaacacgaagccaaacaugguuagaaucaagagaauauacaaaacauuuaauaagaguagaaaauuggauuuuuagaaauccaggauuugcauuagcugcagcugcaauagcauggcuccuggguucaucaacuagucagaaagugauuuauuuaguuaugauacuacuaaucgcacccgcguauucaauaagguguauagguguauccaacagagauuucguagaaggaaugucuggaggaacauggguugauguaguuuuagaacacgguggguguguuacaguaauggcucaagacaaaccaacuguagauauugaacuaguaacaacuacuguaagcaauauggcagaagucagaaguuauuguuacgaagccucaauaagcgacauggcuucagauucuagauguccaacacaaggggaagcauauuuagauaaacaaucagauacacaauaugucugcaaaagaacacuagucgacagaggaugggggaacgguugcggguuauucggcaaaggaucauuaguuaccugcgcaaaauucgcauguagcaaaaaaaugacggguaaaaguauacaaccagaaaaucuugaauauagaauaaugcuaucuguucacgguucacaacauaguggaaugauagucaaugauacaggacaugaaaccgaugaaaacagagcaaaaguugaaaucacaccaaauucaccucgagcagaggcuacauuaggaggcuuugguagucuuggauuagacugugaaccgagaacaggauuagauuuuagugauuuauauuauuuaacaaugaauaauaaacauuggcugguacacaaagaaugguuucaugauauuccacuuccauggcacgcaggugcagauacagguacaccgcacuggaauaacaaagaagcauuagucgaauuuaaagacgcacaugcaaaaagacaaacaguaguuguuuuaggcacucaagaaggugcaguccauacggcacuagcgggggcacuagaagcagaaauggauggugcuaaaggaagacuaaguucaggacauuuaaaauguagauuaaaaauggauaaauuaagacuaaaaggaguaucauauucauuauguacagcagcauuuacauuuacgaaaauuccagccgaaacccuacacgguacuguuacuguagaaguccaauaugcagguacagauggaccauguaaaguaccugcgcaaauggcaguagauaugcaaacacuuacaccaguaggaagauuaauaacugcgaauccaguaauaacggaauccacagaaaauucaaagaugauguuagaauuagauccaccuuuuggagauucauacauaguaaucggaguuggugaaaaaaaaauaacacaucauuggcauagaucaggcucaacaauaggaaaagccuuugaggcaacaguaagaggcgccaaaagaauggcaguccuaggugacacagcaugggauuuuggaucuguaggaggagcauuaaauucccuaggaaaaggaauacaccaaauuuuuggagccgcuuuuaaauccuuauuuggaggaaugucaugguuuucacaaauucuaauuggaacacuauugaugugguuaggcuuaaacacaaaaaacggaagcaucaguuuaaugugucuggcacucggaggaguacuaauauuccuaucaacagcaguuagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7071 - RNA, 2449 nt, Artificial Sequence
  KY075939.1 prME-short mRNA Design 2 opt
ggggcgcugccuacggagguggcagccaucuccuucucggcaucaagcuuaccaugacuucuguaggaauaguaggccuauuguuaacaacugccauggccgcagaagucacaagaaggggcagcgcauacuauauguauuuagauagaaacgaugcaggagaggcaauuucauuuccaacaacacuaggaaugaauaaauguuauauacaaauaauggaucuuggucauaugugugacgcaacaaugucguaugaauguccuaugcuugacgaagguguugaaccagaugauguagauuguuggugcaauacaacaucaacuuggguaguauacggaaccugucaucauaaaaaaggagaggcaagaagaucaagaagagcaguuacgcuaccuagucauucgacaaggaaauuacaaacaagaagucaaacauggcuagaaagcagagaauacacuaaacaccuaauaagaguagaaaacuggauauuuagaaauccuggauuugcacuagcagcugcggcaauagcauggcuauugggcucaucaacaagccaaaaaguaauauaucuagucaugauacucuuaauagcaccagcauacagcuuaagauguauaggagucagcaaucgagauuuuguagaggguaugaguggagguacauggguggauguaguucuugaacauggaggguguguaacaguaauggcucaagauaaaccaacaguagauauagaguugguaacgacaacagucagcaauauggcagaaguaagaagcuacuguuacgaagcaucaauaucagauauggcaagugacucaagauguccaacacaaggagaagcauauuuagauaaacaauccgauacucaauauguauguaaacgaacguuaguagacagagguuggggaaauggauguggccuuuuuggaaaagguucacuaguaacuugugccaaauuugcauguucaaaaaaaaugacaggaaaaucaauacaaccagaaaauuuagaauauagaaucaugcuuucaguccauggaagucagcacucaggaaugaucgucaaugauacaggacaugaaacugaugaaaauagagcuaaaguugaaauuacaccgaauuccccaagggcugaagcaacucuuggcggauuugguagucugggucuagacugcgaaccaagaacagguuuagacuuuucagauuuauacuaccuaacaaugaauaauaaacauugguuagugcauaaagaaugguuucacgauauuccauuaccauggcacgcaggugcagauacagguacaccacauuggaauaauaaagaggcacuaguagaauuuaaagaugcacacgcaaaaagacaaacaguaguaguauuagguucacaagaaggagcaguacauacagcuuuagcaggagcauuagaagccgaaauggacggcgccaaaggaagacuuucaagcgggcauuuaaaaugcagauuaaaaauggauaaacuuaggcuaaaaggaguaaguuauaguuuauguacagccgcuuucacauuuacuaaaauaccagcagaaacacuacacgguacaguuacuguugaaguucaauacgcagguacagauggucccuguaaaguaccagcacaaauggcuguagacaugcaaacgcuuaccccaguaggaagauuaauuacugcaaacccaguaauaacagaaucaacagagaacagcaaaaugauguuagaauuagauccaccuuucggugauucauauauaguaauaggaguaggagaaaaaaaaauaacacaucauuggcauagaagugggaguacaauugguaaagcguucgaagcuacuguuagaggagcaaaacgaauggcgguauuaggagauacagccugggauuucggaaguguugguggagcauuaaauaguuuaggcaaaggaauacaucaaauauucggagcugcauuuaagagucuauucggugguaugaguugguucucacaaauacuaauuggaacacuauuaaugugguuaggauuaaauacaaaaaacggaaguauaucacuaauguguuuagcauuagguggaguuuuaauuuuucuaagcacagcaguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7072 - RNA, 2449 nt, Artificial Sequence
  KY075932.1 prME-short mRNA Design 2 opt
ggggcgcugccuacggagguggcagccaucuccuucucggcaucaagcuuaccaugacgaguguuggcauuguaggguuauuauuaacaacggcuauggcagcagaaguaacaagaagaggaucagcauauuauauguauuuagauagaaacgacgcaggagaagcaauaucuuucccaacaacacuagguaugaauaaauguuauauacaaauaauggaucuaggucauaugugugaugcuacaaugagcuaugaaugcccaaugcuagaugaaggaguagaaccggaugacguagacuguugguguaauacaacaucuacauggguaguauacggaacaugucaccauaagaaaggagaagcaagaagaucgcguagagcagucacacuccccucacauucaaccagaaaauuacaaacuagaagucaaacuugguuagaaucaagagaauauacuaaacacuuaauaagaauagaaaacuggauauucagaaauccaggauuugcauuagcugcggcagcuauagcauggcucuuaggaucuucuaccagucaaaaaguaauauaccuaguaaugauacucuuaauagcaccagcauauucuauacgaugcauuggagugaguaacagagauuuuguugaaggaaugucaggaggaacauggguagacguuguucucgaacacggaggauguguaaccgugauggcucaggauaaaccaacaguagauauugaauuaguaacaacaacaguuucaaauauggcagaaguccgaaguuacuguuacgaagcauccauaucagacauggcaucggauucaagauguccaacccaaggagaagccuauuuagauaaacagucagacacucaauauguuuguaaacgaaccuuaguagaucgaggcugggguaauggauguggacuuuucgguaaaggcagucuuguaaccugcgcaaaauucgcauguaguaagaaaaugacaggaaaaaguauccaaccagaaaaccuggaauauagaauuaugcuaucaguccacggaucacaacauucaggaaugauaguaaaugauacuggucaugaaacagaugaaaauagggcaaaaguagaaauaacuccaaauucaccacgagccgaggccacccuuggaggauuuggaucauuaggccuagauugcgaaccuagaacaggauuagauuuuagugauuuauacuauuuaaccaugaacaacaaacauugguuaguucauaaagaaugguuucaugauauaccauuaccauggcaugcuggagcagauacagguacaccacauuggaacaauaaagaagcauuaguugaauuuaaagaugcacacgcuaaacgucaaacuguuguuguuuuaggaucacaggaaggagcuguacauacagcauuagcgggugccuuagaagcagaaauggacggagcaaaaggucgacuaaguaguggucacuuaaaauguagauuaaaaauggacaaauuaagauuaaaagguguuuccuauuccuuauguacagcagcguuuaccuucaccaaaauaccagcagaaacccuacacggaacaguaacaguagaaguacaauaugcagguacagauggacccuguaaaguuccugcacaaauggcaguagacaugcaaacuuuaaccccaguaggaagauuaauaacagccaauccagugauuacagaauccacagaaaacucgaaaaugauguuagaauuggauccaccauucggugauaguuacauaguuauaggaguaggagaaaagaaaauuacacaccauuggcacagaagcggaagcacaauaggaaaagcauucgaagcaacaguaagaggagcaaaaagaauggcugucuuaggagauacagcaugggauuucgguucuguuggcggagcuuugaacaguuugggcaaaggaauacaucaaauauuuggggcagcauuuaagagcuuauuuggagguaugucaugguucucacaaauauuaauaggaacauuacuaauguggcuaggauuaaauacgaaaaauggcagcauuucacuaaugugucuagcauuagguggagucuuaauauuucuaucaacagcaguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7073 - RNA, 2449 nt, Artificial Sequence
  KU870645.1 prME-short mRNA Design 2 opt
ggggcgcugccuacggagguggcagccaucuccuucucggcaucaagcuuaccaugacaucagugggaauugugggauuauuauuaacaaccgcuauggcagcagaagucacuagaagaggaucugcauauuacauguaucuagauagaaacgaugcaggagaagcaauaaguuucccaacaacauuagguaugaauaaauguuacauacagauaauggaucuaggucauaugugcgaugcaacuaugaguuaugaaugcccaauguuagaugaaggaguagaaccagaugauguagauuguugguguaacacaacaucaacauggguagucuacggaacaugucaucauaagaaaggugaagcuagaagaagccgcagggcaguaacuuuaccgucgcacucaacaagaaaacuucagacaagaagucaaacuugguuagaaaguagagaauauacaaaacauuuaauccguguagaaaauuggauauuaaggaacccaggauucgcauuagcagcagcggcaauagccugguuacuagguucaagcacgucacaaaaaguaauauacuuagucaugauacuguuaauugcaccagcauauagcauucguuguauuggcguaucuaacagagauuucguugaaggaaugucgggaggaacauggguugauguaguucuagaacauggcgguuguguaacaguaauggcccaagauaaaccaacaguagauaucgaacucguaacuacaacgguauccaauauggcagaaguucgaaguuauuguuacgaagcaaguauaagugacauggccuccgauucaagauguccuacgcagggugaggcuuaucuagacaaacaaucggacacacaauauguauguaaaagaacauuaguagauagaggauggggaaauggauguggacuauuuggaaaaggaaguuuaguaaccugugcaaaauuugcuugcaguaagaaaaugacagguaaaagcauacaaccagaaaaucuugaauauagaauaaugcugagcguacacggcagccaacacucuggaaugauuguaaacgauacugggcaugaaacagaugaaaaucgagcaaaaguagaaauaacaccaaacagcccaagggcugaagcaacccuggguggauuuggaaguuugggucuagauugcgaaccaagaaccggucuagauuucucagauuuauauuauuuaacgaugaauaauaaacauugguuaguacauaaagaaugguuccaugauauaccauuaccauggcaugcaggagcugauacaggaacaccacauuggaauaacaaagaagcauuaguagaguucaaagaugcacacgcaaaaagacaaacuguaguaguacuaggaagucaagaaggagcaguccacacagcauuagcaggagcucuagaagcagaaauggauggugcaaaaggccgacuaucuucuggacauuuaaaauguagauuaaaaauggacaaacuaagauuaaaaggagugucauacucauuaugcacagcagcauuuacauuuacaaaaauuccagcagaaacacuacauggaacaguaacuguagaaguccaauaugccggaacagacggaccuuguaaaguaccagcacaaauggccguagauaugcaaacauuaacaccuguagguagacuaauuacagccaauccaguaauaacugaauccacugaaaauagcaaaaugaugcuagaacuggauccuccauuuggagauucauauauagucauagggauaggagagaaaaagauaacacaccacuggcauagaucuggaaguacuauagguaaagcauucgaagcaacaguaagaggugcaaaaaggauggcaguauuaggagacacagccugggauuucggaucaguaggaggugcauuaaauucauuaggaaaagguauccaccaaauuuucggagcagcuuuuaaaucuuuauucgguggaaugaguugguuuucacaaauauuaauuggaacuuuacuaauguggcuaggauuaaauaccaaaaauggaucaauaagucuuaugugucuagcauuagguggaguacuuauauuucuaaguacagcaguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7074 - RNA, 2449 nt, Artificial Sequence
  KU729217.2 prME-short mRNA Design 2 opt
ggggcgcugccuacggagguggcagccaucuccuucucggcaucaagcuuaccaugacuucaguaggaaucgucggacuuuuguuaacaacggccauggcugcagagguaacaagaagaggaucagcuuauuacauguauuuagauaggaaugaugcuggagaagccauaaguuucccaacuacacuaggaaugaauaaauguuauauucaaauaauggauuuaggucauaugugugacgccacuaugaguuacgaguguccaauguuggaugaaggcguagaaccagacgauguugacuguuggugcaacaccacaucaacauggguaguauaugguacaugucaucauaagaaaggagaagcaagaagaucaagaagggcaguaacacucccuucacauucaacaagaaaauuacaaacgagaagccagacauggcuagagucaagagaauauacuaaacacuuaauaagaguagaaaauuggauauucagaaauccaggguuugcauuagcagcagcagcaauagcuugguuacuaggaaguaguacgucacaaaaaguaauauaucuuguaaugauuuuauuaauugcaccagcuuauagcauuagauguauaggcguuuccaaccgugauuuuguugaaggaaugucuggaggaacauggguugauguagugcuagaacacggaggauguguaacaguuauggcacaagauaaaccaacaguggacauagagcuaguaucaacuacugucagcaauauggcggaaguaagaucauacuguuacgaagccacaauaagugauauagcaucagacucaagaugcccaacacaaggagaagcauaucuagacaaacaaucagacacucaauauguauguaaaagaacauugguagauagaggauggggaaauggaugcggauuauuuggaaaaggcaguuuaguuacaugugcaaaauuugccugcaguaagaaaaugacuggaaaaucaauacaaccugaaaauuuagaauauagaauaauguuaucaguacaugggucucagcacucaggaaugauagucaaugacacaggacacgaaacugaugaaaauagagcuaaaguugaaauaacaccaaauagcccacgagcagaagcaacauuaggaggcuuuggaaguuuaggacuagauugugaaccaagaacaggccuagacuuuucagaucuauauuauuuaacaaugaacaacaaacauuggcuaguacacaaagaaugguuccacgauauaccauugccauggcacgcaggagcagacacaggaacuccacauuggaauaauaaagaagcucuuguagaauuuaaagaugcacaugcaaaaagacaaacagccguaguacuagguucacaagaaggagcuguacacacagcacuagcuggagcauuagaggcagaaauggauggagcuaaaggaagauugucgagugggcaucuaaaaugcagauuaaaaauggacaaauuacgauuaaaaggaguaucuuauucacuaugcaccgccgcauuuacauuuacaaaaauaccggcagaaaccuuacauggaaccguaacaguugaaguacaauaugcaggaacagaugguccauguaaaguaccagcucaaauggcaguugauaugcaaacauuaacaccagucggaagacuuauaacagcaaauccaguaauaacagaauccacagaaaauagcaaaaugaugcuggaacuagauccuccauuuggggacucauacaucguaauaggaguaggagaaaagaaaauaacgcaccauuggcauagaagugguaguacaauaggaaaagcauucgaagcuacaguaagaggagcgaaaagaauggcaguauuaggugacacugcuugggauuuuggaucagucggcggggcauuaaauucauuagguaaaggaauacaucagauuuuuggagcagccuuuaaaucauuauuuggugggaugaguugguuuucacaaauauuaauaggaaccuuacuuaugugguuaggcuuaaauacuaaaaaugguagcauaucacuuaugugcuuagcauuagguggagucuuaauauuuuuaucuacagcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7075 - RNA, 2449 nt, Artificial Sequence
  KX087101.3 prME-short mRNA Design 2 opt
ggggcgcugccuacggagguggcagccaucuccuucucggcaucaagcuuaccaugacaagcguagguauaguugguuuacuuuuaacaacagcaauggcagcagaaguaacuagaagaggaagugcauauuauauguaccuagaucguaacgacgcgggugaagcaaucagcuuucccaccacuuuaggaaugaauaaauguuacauacaaauaauggacuuaggacauaugugugaugcaacaaugaguuaugaauguccaaugcuagaugagggaguugaaccagaugaugucgacuguugguguaauacaacaaguacuuggguuguauaugggacuugucaucauaagaaaggugaagcuaggagaucaagacgcgcagugacacuaccuagucauagcacuagaaaacuccaaacacgaucacaaacaugguuagaaucacgcgaauacacaaaacacuugauacguguagaaaacuggauauuucguaacccagguuucgcacuggcagcagcagcaauagcauggcuauuaggaaguagcacuucacaaaaagucauauaucuagucaugaucuuauuaauagcaccagcauauaguauaagaugcauagggguaucaaacagagauuucguagaaggaaugaguggaggaacauggguagacguaguacuggaacacggaggaugcguaacuguaauggcacaagacaaaccuacaguagauauagaguuaguaacgacuacaguuaguaacauggcagaaguuagaaguuauuguuaugaagcaaguauaagugauauggcaagcgauaguagaugcccaacccaaggagaagcauauuuagauaaacagagcgacacucaauauguuuguaaaagaacuuuaguagacaggggaugggggaacggauguggacuauuuggaaaaggauccuugguuacaugugcaaaauuugcauguucaaagaaaaugacaggaaaaucaauccagccugaaaaccuugaauacagaaucaugcuaagcguacaugggucacaacacucaggaaugauaguaaacgauacgggacaugaaacagaugaaaacagagcaaaaguggaaauaaccccaaauagcccacgagcagaagcaacucuuggagguuuuggaucucuaggauuagauugugaaccccgaacuggucuagauuuuagugacuuauauuaucucacuaugaauaacaaacacugguuaguacauaaagaaugguuccaugauauaccacuacccuggcaugcuggagcagacacgggaacaccacauuggaauaauaaagaagcucuaguagaauuuaaagaugcacacgcaaaaagacagacaguagugguauuaggaucacaagaaggugcaguacauacagcacuugcaggagcccuagaagcagaaauggacggagcaaaaggccgacuaaguaguggacaucuaaaauguagauuaaaaauggacaaauuaagacuaaaaggaguaucuuauucauuauguacagcggcauuuacauuuacuaaaauacccgcugaaacacuacacggaaccguaacaguagaacuacaauaugcagguacagaugguccauguaaaguaccugcccaaauggcuguagauaugcaaacguuaacaccaguuggaagguuaauaaccgcaaacccaguaauaacagaaucaacggaaaacagcaaaaugauguuagaauuagacccaccauuuggugacucauauauaguaaucggaguaggagaaaagaaaauaacacaucacuggcauagaaguggaaguacuauaggaaaagcauuugaagcaacaguaagaggagcaaaaagaauggccguauuaggagauacugcuugggauuuugguucaguagguggagcacuaaacagucuaggaaaaggaauacaccaaauauuuggugcagcauuuaaaagucuauucggcggaaugucgugguuuucacaaauacuaauagguacacuauuaauguggcuuggacuuaauacuaaaaauggaagcaucagcuuaauguguuuagcauuaggaggcguccuaauauucuuaaguacagcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7076 - RNA, 2449 nt, Artificial Sequence
  KY014317.1 prME-short mRNA Design 2 opt
ggggcgcugccuacggagguggcagccaucuccuucucggcaucaagcuuaccaugacaagcguaggcauaguaggauuacuauuaacaacagcaauggcugcagaaguaacaaggcgaggaagugcauauuauauguauuuagauagaaaugacgcaggcgaagcaauaaguuuuccaacaacauuaggaaugaacaaauguuacauacaaauaauggauuuaggacauaugugugacgcaacaaugucauaugaauguccaauguuagaugaaggaguggaaccagaugauguagacuguuggugcaauacuacaaguacguggguaguauacggaacgugccaucauaaaaaaggagaagcccgaagaagccgaagagcuguaacucuacccagccauucuacccgcaaauuacaaaccagaucacaaaccugguuagaaucaagagaauauacaaaacacuuaauuagaguugagaauuggaucuuuagaaaucccgguuuugcauuagcagcagcggcaaucgcauggcuauuaggaucuucaacaucacaaaaaguaauauacuuaguaaugauauuauuaauagcuccagcauacaguauaagauguauaggaguaucaaauagagauuucguugaaggaaugucuggaggaacauggguagauguaguacuagaacacggcggauguguuacaguaauggcacaagauaaaccuacaguagauauagagcucgucacaacuaccguuucaaauauggcagaaguaaggucauauugcuacgaagcaagcaucagugauauggcaagcgauucaagauguccaacucaaggagaagcauaucuagacaaacaaucagacacacaauauguaugcaaaagaacacuuguagacaggggaugggguaaugggugcggccuauucgguaaagguucgcuaguaacaugcgcgaaauuugcaugcaguaaaaaaaugacagguaaaaguauucaaccagaaaacuuagaauauaggauaaugcuaucuguucauggaucacaacacagcggaaugauaguaaaugauacuggacacgaaacagaugaaaaccgagcaaaaguagaaauaacaccaaauagcccaagagcugaagcaacucuagguggauuugguucacuagguuuggacugugaaccaagaacaggacuggauuuuucagaucuauauuauuugaccaugaacaacaaacauuggcuuguacauaaagaaugguuccaugauaucccauuaccauggcaugcaggcgcggauacaggaacaccacauuggaauaacaaagaagcacuaguggaguucaaagacgcacacgcaaaaagacagacaguaguaguacuaggaucacaagaaggagcaguucauacagcuuuagccggcgcuuuggaagcagaaauggauggagcaaaagguagacuuaguuccggccaucuuaaaugucgacugaaaauggauaaacuacgacuaaaaggagugucauauucacucuguacagcagcauuuacuuucacuaaaauaccagcagaaacauuacauggaacuguaacaguagagguacaauaugcuggcacagacggcccauguaaaguaccagcacaaauggcugucgauaugcagaccuuaacuccuguugguagacuaauaaccgcaaauccaguaauuacagaaaguauagaaaauagcaaaaugaugcuugaacuagauccaccauuuggugauucguauauaguuauagggguuggagaaaaaaaaauaacucaucauuggcauagaucaggaucaacuauaggaaaagcauuugaagcuacaguaagaggagcaaaaaggauggcaguuuuaggugacacagcaugggauuuugguucuguaggaggagcauuaaacucccuagguaaaggaauacaucaaauauuuggugcagccuuuaaaagccuauuuggagguaugucuugguuuucacaaauauuaauaggaacacuucuaauguggcuaggacuaaacacuaagaauggaaguaucagcuuaauguguuuagcacucggaggaguacuaauauuuuuaucaacagcaguguccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7077 - RNA, 2449 nt, Artificial Sequence
  KU758876.1 prME-short mRNA Design 2 opt
ggggcgcugccuacggagguggcagccaucuccuucucggcaucaagcuuaccaugacaucaguuggaauaguaggucuauuacuaacaacagcaauggcugcagaaguaacucggcguggaagcgcuuauuacauguacuuagacagaaaugaugcaggcgaagcaauaucauuuccaacaacacuaggcaugaauaaaugcuacauacaaauaauggauuuagggcauaugugugaugcaacuaugucuuacgaauguccaauguuagaugaaggcguagaaccagaugauguagauuguuggugcaauacaacuucaacauggguaguauacgguacaugucaucacaagaaaggagaagcuagaagaucaaggagagcgguaacacuaccuagucauaguacaagaaaacuacaaacucgaucacaaaccugguuagaaucacgugaauacacaaaacauuuaauaaggguagaaaauuggauauucagaaauccagguuuugcacuggcagcagcugcaauagcauggcuuuuaggaucaagcacaagucaaaaagucauauaccuggugaugauauuauuaauagcuccagcuuauaguauacgauguauaggaguaaguaauagagauuucguagaaggaaugucaggagguacaugggucgaugucguucuagaacauggaggaugugucacgguaauggcacaagacaaaccaacaguagauauugaauugguaacuacaacuguaagcaacauggcagaaguaagaucauauuguuacgaagcaucuauaagugacauggcaucagauucacgaugcccaacacaaggugaagcauauuuagauaaacaaucugacacucaauauguauguaaaagaacucuaguagaucgaggauggggaaaugguugugggcuauuuggaaaaggaagccuaguaacaugcgcaaaauuugccuguucaaagaaaaugacaggaaaaucaauccaaccagaaaaccucgaauauagaauaaugcuaucaguacacggaucacaacacagcggaaugauaguaaaugacacaggacaugaaacagacgaaaacagagcaaaaguagaaauaacacccaauagccccagagcugaagcaacauuaggaggauucggaaguuuaggacuugacugugaaccaagaacaggauuagacuucagcgaccuauauuauuuaacaaugaauaacaaacauuggcuaguacacaaagaaugguuucacgauauaccuuuaccauggcacgcaggcgcugacacugguacuccacacuggaauaacaaagaagcacuuguagaauuuaaagaugcgcaugcaaaaagacaaacaguagugguacuaggcucucaagaaggugcaguacauacagcacuagcaggcgcauuagaagccgaaauggauggcguaaaaggaagacuaucaucggggcauuuaaaaugucgucuaaaaauggacaaauuaagacuaaaaggaguaucguauucauuaugcaccgcagcauucacauuuacaaaaauaccagcagaaacauuacauggaacaguaacaguagaaguacaauaugcagguacagacggaccauguaaaguuccagcacaaauggcaguggacaugcaaacauuaacaccgguaggaagauuaauaacugcaaauccaguuaucacggaaaguacagaaaauuccaaaaugauguuagaguuagacccuccauuuggagauaguuauauaguuauugguguuggggaaaagaaaauaacucaucacuggcauagaucaggcaguacgauaggaaaagcauuugaagcuacaguacgaggcgccaaaagaauggcaguauuaggagauacagcaugggacuuugguagcguagguggagcccuaaauucauugggcaaagguauucaucaaauauuuggagcugcauuuaaaagccucuucgguggaaugaguugguuuucucaaauacuaauaggaacauuauuaaugugguuaggacuaaauacuaaaaaugguucuauuagcuuuauguguuuggcacuaggaggagucuugauauuucuaaguaccgcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7078 - RNA, 2449 nt, Artificial Sequence
  KU758874.1 prME-short mRNA Design 2 opt
ggggcgcugccuacggagguggcagccaucuccuucucggcaucaagcuuaccaugacaucuguugguaucguaggauuauuacucacaacagcaauggcggccgaaguaacuagaaggggaucagcauauuauauguaucuagauagaaacgaugcaggagaagccauaaguuuuccgacaacauuaggcaugaacaaaugcuauauacaaauaauggauuuagggcauaugugugaugcaaccaugagcuaugaaugcccaauguuagacgaaggaguagaaccagacgacguagauuguugguguaacacgacaaguacaugggucguauacggaacuugucaucauaaaaaaggagaagcuaggcguucaagaagagcaguaacauuaccaucacauucaacacgaaaacuucaaacaagaucacaaacauggcuagaaucaagagaauauacuaaacauuuaauaaggguugaaaacuggauauuuagaaacccaggauuugcccuagcugcagcagcaaucgcauggcuacuaggaucaaguacaagccaaaaaguaauauaucuaguaaugauacuauuaauagcuccagcauacucgauuagaugcauagguguaucaaauagagacuucguagaaggaauguccggaggaacauggguagacguaguguuagaacauggaggauguguuacaguaauggcacaggacaaaccaaccguugacauagaauuaguuacaacaacaguuaguaacauggcugagguacguucauauuguuaugaagcaucaauaucagacauggcaucagauucacgaugucccacucaaggugaagcauacuuagauaaacaaagcgacacacaauacguuuguaaacgaacacuaguagauagaggaugggggaauggauguggccuauuuggaaaaggaagccuaguaacaugugcuaaauuugcauguaguaaaaaaaugacaggaaaaagcauucaaccggaaaacuuagaauauagaauuauguuaucaguacaugguucacaacauucagggaugauaguaaaugauaccggacaugaaacugacgaaaacagagcaaaaguagaaauaacuccuaauaguccaagagcagaagccacauuagggggauuugggagucuaggacuagauugcgaaccuagaacaggauuagauuuuucagaucuauauuauuuaacaaugaacaauaaacacuggcuuguucauaaagaaugguuucacgacauaccacuaccauggcaugcaggagcagauacaggaacaccacauuggaacaauaaagaagcauuaguggaauuuaaagaugcacaugcaaaaaggcaaacugucguaguucuagguucccaagaaggugcuguacauacugcacuagcaggggcacucgaagcagaaauggacggagcuaaaggaaaacuaaguucagggcaccuaaaaugcagauuaaaaauggauaaauuacguuuaaaaggaguaucauauucauugugcacagcagcauuuacauuuacaaaaauuccggccgaaacguuacauggcaccguuacgguagaaguacaauacgcaggaacagaugggccauguaaaguaccugcccaaauggcaguugauaugcaaacacugacaccgguugggagacuaauuacugcuaacccaguaauaacugaaucaacagaaaauucaaaaaugauguuagaauuagauccaccauucggcgauagcuauauuguaauaggaguaggugaaaaaaaaauaacacaccauuggcacaggagcgguaguacaaucggcaaagcauuugaagcaacuguuagaggagcuaaaagaauggcaguguugggcgauacagcaugggauuuugggaguguaggaggggcacucaacucauuaggaaaagguauacaucaaauauucggagcagcuuuuaaaucauuauucggaggaaugagcugguuuagucaaauacuuauaggaacacuauuaaugugguuaggauuaaauacaaagaacggaagcauaucauuaauguguuuagcacuuggaggaguuuuaauauuucuaaguacagcugucagugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7079 - RNA, 2449 nt, Artificial Sequence
  KY317939.1 prME-short mRNA Design 2 opt
ggggcgcugccuacggagguggcagccaucuccuucucggcaucaagcuuaccaugacaagcguaggaauuguaggacuacuguuaacaacagcaauggccgccgaaguaacaagaagaggcagcgcauauuauauguacuuagauagaaaagaugcuggagaagcaaucuccuuuccaacaacauuagguaugaauaaauguuauauacaaauaauggaucuaggacauaugugugacgcaacaaugucuuaugaauguccaauguuagaugaaggaguagaacccgaugauguagacugcugguguaauacgacaucaacuugggugguauacggaacaugccaccauaaaaaaggagaagcaaggagaucacguagagcaguuacacuuccuucucauucaacuagaaaauuacaaacacgaagccaaacuugguuagaaagcagagaauauacaaaacauuuaauaagaguagaaaacuggauauucagaaauccaggauuugcacucgcagcagcagcaauagcauggcuauuggggucaagcacaucacaaaagguaauauacuuaguuaugauauuauuaauugcaccagccuauucuauaagauguauaggaguaucuaacagagauuuuguugaagguaugucaggcggaacauggguagaugugguucuugaacaugguggauguguaacaguaauggcacaagauaaaccaacaguagauauagaauuaguaacaacaacaguaaguaacauggcagagguaagaaguuauuguuaugaagcaaguaucucagauauggcaagcgacucuagaugcccaacacaaggagaagcauaucuagauaaacaaagugacacacaauauguauguaaaagaacacuaguagauagaggauggggaaauggauguggacuuuuuggaaaagguucguuaguuacuugcgcaaaauuugcauguucaaaaaaaaugacuggaaaaaguauacaaccagaaaacuuagaguauagaauaauguuaucaguacacgggucucaacauaguggaaugauuguuaaugacacuggacaugagacagaugaaaauagagcaaaaguagaaauaacuccaaacucaccccgugcagaagcgacauuaggaggauuugguucauuaggauuagauugugaacccaggacgggacuagauuuuagugaucuauauuaucuaacuaugaauaauaaacauugguuaguacauaaagaaugguuucacgacaucccauuaccauggcacgcaggagcagauacaggaacaccucauuggaauaauaaagaagcauuaguugaauuuaaagacgcucaugcaaaacgucaaaccguaguuguacuagguagccaagaaggagcaguacauacugcauuagcaggagcauuagaagcagaaauggauggcgcgaaagguagauuaagcaguggccauuuaaaauguagacucaaaauggauaaacucagauuaaaaggaguuucauauagucuauguacagcagcauuuacauuuacaaaaauaccagccgaaacacuccauggaaccguaacaguagaagugcaauacgcaggaacagauggaccgugcaaaguaccagcccaaauggcaguagauaugcaaacauuaacaccuguaggaagauuaauaacagcaaauccaguaauuacagagucaacagaaaacagcaaaaugauguuagaacuagaucccccauucggagauaguuauauuguaauagguguaggugaaaaaaagaucacacaucauuggcacagaucaggaucaacaauugggaaagcuuucgaagcaacagucagaggugcaaaacgaauggcaguacuaggagauacagcgugggacuucggaaguguagguggagcacuaaacucacuggggaaaggaauacaccaaauauucggagcagccuuuaaaucacuauuugggggcaugucuugguucucucaaauacuaauuggaaccuuauuaauguggcuaggacuaaacacuaaaaauggaagcaucaguuuaaugugucuagcacuuggagguguuuuaauauucuuaucgacagccguuuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7080 - RNA, 2449 nt, Artificial Sequence
  KY014314.1 prME-short mRNA Design 2 opt
ggggcgcugccuacggagguggcagccaucuccuucucggcaucaagcuuaccaugacaaguguaggaauuguaggacuauuauuaacaacagcuauggcugcagaaguaacaagaagaggcagugcauacuauauguauuuagauagaaaugacgcuggagaagcaauuagcuucccaacaacauugggaaugaauaaaugcuacauacaaauaauggauuuaggccauaugugugaugcaacaaugaguuaugaaugccccaugcuagacgaaggaguugaaccagaugauguagauugcugguguaauacaacuucaacauggguuguuuaugguacaugucaccauaaaaaaggagaagcaaggcguucaagacgagccguaacacucccuucgcacucaacucgaaaauuacaaacccgaagccaaacauggcuagaaucaagagaauauacaaaacaucugauaagagucgaaaacuggauauuuagaaauccaggauuugcacuagcagcagcagcaaucgcauggcugcuugggagcucaaccucucaaaaagugaucuaucuuguaaugauacuguugauagccccagcauacucaauaagauguauagguguaagcaauagagauuucguagaaggcaugucaggaggaacauggguugauguaguauuagaacacggagguugcguuacagugauggcacaagacaaaccaacaguagacauagaacuaguaacaaccacuguaaguaauauggcagaaguacgaucuuauuguuaugaagcuaguauuucagauauggcaucggauucaagguguccuacucaaggugaggcauaccuagacaagcaaucagacacucaauacguaugcaaaagaacacuaguugauagaggauggggaaauggauguggauuguucggaaaagguucauugguaacaugugcaaaauuugcgugcucuaaaaaaaugacagguaaaucuauacaaccggaaaacuuagaguauagaauaaugcuaaguguacauggcucucaacauucuggaaugauuguaaaugauacaggacaugaaacagaugaaaauagagcaaaaguagaaauaacgccaaauaguccacgagcggaagcaacacuaggaggauuugguaguuuaggauuagacugugaaccgagaacaggauuagauuucagcgaccuauauuauuuaacgaugaauaauaaacauugguuaguacauaaagaaugguuucaugacauuccccucccauggcacgcaggggcagacacagggacaccacauuggaacaauaaagaagcacuaguagaauuuaaagaagcacacgcaaaaagacaaacaguuguaguacuaggaagucaagaaggagcaguacauacagcacuagcaggagcuuuagaagcagaaauggauggagcaaagggaagacuaucuucuggacacuuaaaauguagauuaaaaauggauaaacugagacuaaaagguguaucauauucguuauguacagcagccuucacauuuacuaaaauaccagcagaaacucuacauggaacgguuacaguagaaguacaauaugccggaaccgauggcccgugcaaaguaccagcacaaauggcaguggauaugcaaacauuaaccccaguaggaagauuaauaacagcaaauccaguaauaacagaaucaacagaaaauagcaaaaugauguuagaauuagauccaccuuuuggagauagcuacauaguaauaggagucggagaaaaaaaaauaacucaccauuggcacagaagcggaucaacaauaggaaaagcauuugaggccacaguuagaggagcaaaaagaauggcaguacuaggagacacugccugggauuuuggaagcguuggaggggcauuaaauagucuugguaaagggauucaucaaauauucggggcagcauuuaaaucacuauuuggaggaaugaguugguucucacaaauauugauaggaacauugcuaaugugguuaggacuaaauacaaaaaauggcagcauaagccucaugugucuugcucuaggaggaguucuaauauuuuuaaguacugcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7081 - RNA, 2449 nt, Artificial Sequence
  KX447517.1 prME-short mRNA Design 2 opt
ggggcgcugccuacggagguggcagccaucuccuucucggcaucaagcuuaccaugacaaguguuggaauaguaggauuacuacuaacuacugcaauggcagcagaaguaacuagaagaggcucagcuuauuacauguauuuagacaggaacgaugccggcgaagcgauaaguuuuccuaccacacuaggaaugaacaaauguuacauacaaauaauggauuugggacauaugugugaugcuacgaugagcuaugaguguccaaugcuagacgaaggaguugaaccugaugacguagauuguugguguaacacaacaagcacauggguuguauauggaacaugucaucacaaaaaaggagaagcuagaagaucaagaagagcagucacauuaccaagucauagcacaagaaaacuacaaacaagaucacaaacaugguuagaaucaagagaauauacaaaacaccuuauaagaguugaaaauuggauuuuuagaaauccaggauuugcuuuagcagcugcagcaauagcaugguuacucgguucuucaacaagccaaaaaguaaucuaucuaguaaugauauugcuaauugccccagcguacucuauucgauguauuggcguaucaaacagagauuucgucgaaggaaugucaggaggcacauggguagacguuguacuagaacacggagggugcguaacaguaauggcacaggacaaacccacaguugauauagaauuaguaaccacaacgguaucaaacauggcggaaguuagaucuuauuguuaugaggcaaguauaagugauauggcaucagauaguagauguccaacccaaggugaagcauacuuagauaaacaaucagacacacaauacguauguaaaaggacacugguagacagaggauggggaaauggauguggauuauuugguaaaggaaguuuaguaacaugugcaaaauuugcauguucaaaaaaaaugacgggaaaaaguauacaaccagaaaauuuagaauauagaauuauguuaaguguucauggaagccaacauagcgguaugauagugaacgacacaggucacgaaacugaugaaaacagggcgaaaguagaaauaacaccaaauaguccgcgcgcagaagcagcuuuaggaggauucggaucacuggguuuagauugcgaaccaagaacagguuuagauuucagugacuuguacuaccuaacaaugaauaauaaacauugguuagugcacaaagagugguuucaugauauaccauugccauggcaugccggagcagauacaggcacgccacauuggaauaauaaagaggcguuaguugaguucaaagaugcacaugccaaacgacaaacaguaguaguauuaggaucacaagaaggggcaguucacacagcauuagcaggagcauuagaagcagaaauggacggagcuaaaggaagauuaagcucaggacaccuaaaauguagauuaaaaauggauaaguugcgauuaaaagguguaucuuacucacuuuguacagcagcuuucacauuuacaaaaauacccgccgaaacacuacacgguacaguaacaguagagguacaauaugccggaacagauggaccauguaaaguuccagcacagauggcaguagauaugcaaacauuaacaccugucggaagauuaauaaccgcaaauccagugauaaccgaaucuacugaaaauucaaaaaugauguuagaauuagacccuccauuuggagauucauacauaguuauaggaguaggagagaaaaaaauuacacaucauuggcauagauccgguucaacuauaggaaaagcauuugaagcuacaguaagaggcgcaaaacguauggcaguauuaggagacacggcaugggauuucggaucaguaggaggagcauuaaacucauuaggaaaaggaauacaccaaauuuucggugcggccuuuaaaucauuauuugguggaaugagcugguuuucgcaaacauuaauaggcacuuuacucaugugguugggacuuaauacaaaaaauggaagcauaucacucauguguuuagcacugggaggaguacuuauauuuuuauccacugcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7082 - RNA, 2449 nt, Artificial Sequence
  KU926310.1 prME-short mRNA Design 2 opt
ggggcgcugccuacggagguggcagccaucuccuucucggcaucaagcuuaccaugacaaguguagguauuguaggacuuuuauuaacuacagcaauggcagcagagguuacuagaagaggaucugcguauuauauguaucuagacagaaaugacgcaggagaagcaauaucuuuuccuacgacauuaggaaugaauaaaugcuauauacaaauaauggauuuaggccacaugugcgaugcaaccaugucauaugaauguccaauguuagaugaaggaguugaaccagaugauguagauugcugguguaauacaacaucaaccuggguaguauauggaaccugucaccacaaaaaaggcgaagcaagaagaaguagaagagcaguaacauuaccaucacauagcacacgaaaacuucaaacacgaagccaaacauggcuugaaaguagagaauauacuaaacaucuaauaagaguagaaaacuggauauucagaaauccaggcuuugcauuagcagcagcugccauugcauggcuauuaggcaguucaacaucacaaaaaguaauuuauuuaguaaugauucuauuaauugcaccugcauauaguauaaggugcauaggaguuuccaauagagauuuuguagaaggaaugucaggagguacauggguagauguaguucuagaacauggugguuguguaacaguaauggcucaggauaaaccaacaguagauauagaacuaguaacgacaacaguaagcaacauggcagaaguuagaagcuauugcuacgaagcaaguauaucagauauggcaagcgauucacgauguccaacacaaggagaagcuuaccuugacaaacaaucugauacucaauauguaugcaaaaggacguuaguagaucgugguuggggaaaugguuguggcuuauucggaaaaggaagucuaguuacaugcgccaaauuugcauguaguaaaaagaugacagguaaaucaauacaaccagaaaauuuagaauaucgaaucauguuaucaguacaugguucacaacauucugguaugauuguaaaugacacaggacaugaaacagacgaaaauagagcaaaaguagaaaucacaccaaacucuccaagagcugaagcaacuuuaggaggguucggcucguuaggauuagauugugaaccaagaacgggacuagacuuuucagaucuauauuauuugacaaugaauaauaaacacuggcuaguucauaaagaaugguuucaugauauaccacuaccauggcaugccggagcagacacuggaaccccccauuggaauaacaaagaagcacuaguagaauuuaaagaugcucacgcgaaacgacaaacuguaguaguacuuggaucacaagaaggagcaguacacacagcauuagcaggagcuuuagaagcugagauggacggcgcuaaaggacgacuaaguucaggccauuuaaaaugcagauuaaaaauggauaaacuaagauuaaaaggaguuucauauucacuauguacagcagcuuuuacauuuaccaaaauaccugcagaaacauugcauggaacaguuacaguagaaguacaauacgcuggagcugauggaccuuguaaaguacccgcucaaauggcaguagauaugcagacauuaacaccagucggaagauuaauuacagccaauccaguaauuacagaaucaacggaaaauucaaaaaugauguuagagcuagacccgccauuuggagauucauauauugugaucgguguaggcgaaaaaaaaauuacacaccauuggcauagaucagguucuacaauaggcaaagcguuugaagcaacugugaggggcgcaaaaagaauggcaguauuaggagauacugcaugggauuucggaaguguaggaggagcacuaaacucccugggaaaagguauccaucaaauauuuggagcggcguucaaaucauuauucgguggaaugucaugguucucacaaauccucauaggaacuuuauuaaugugguuaggacuuaauacaaaaaauggcaguauaucauuaaugugccuagcacuaggaggagucuuaauauuuuuaaguacugcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7083 - RNA, 2449 nt, Artificial Sequence
  KU922923.1 prME-short mRNA Design 2 opt
ggggcgcugccuacggagguggcagccaucuccuucucggcaucaagcuuaccaugacaucagugggaauaguagguuuacuacuaacaacagcaauggcagcagaaguaacaagaagaggaucugcauauuauauguauuuggauagaaacgaugcaggggaagcaaucaguuuuccuacaacguugggaaugaauaaauguuauauacaaauaauggaccuaggacauaugugugaugcuacaaugucguaugaaugcccgaugcuggaugaagggguagaaccagaugauguagacuguugguguaauacaaccaguacaugggugguauauggaacaugucaucauaaaaaaggugaggcucgacgaaguaggagagccguaacauuaccuucacauucaacaagaaaauuacaaacaaggucacaaacaugguuagaaaguagagaauauacaaaacaucuaauuagaguugaaaacuggauauuuagaaacccaggguucgcuuuggcagcagcagcaauagcaugguuauuaggaagcucaacaucucaaaaaguuauauaucuagucaugauauuacuuauagcauuagcuuauuccauacgauguaucggaguaucaaauagagauuucguagaaggaaugucaggaggaacauggguugacguaguguuagaacaugguggcuguguaacaguaauggcacaagauaagccaacaguagacauugaauuaguaacuacaacaguaaguaauauggcagaaguaagaucuuauuguuacgaagcaaguaucagcgauauggccuccgauucaagaugcccgacacaaggugaagcauauuuagauaaacaaagcgauacgcaauacguauguaaacguaccuugguagacagagguugggguaauggaugcggauuauuuggaaaaggcucacuuguuacgugugcaaaauucgcaugcucaaaaaaaaugacuggaaaauccauacaaccagaaaaucuagaauauagaaucaugcuauccguacauggaucccaacauucagguaugaucguaaaugauacagggcaugaaacagaugaaaauagagcgaaaguagaaauaaccccaaauaguccaagagcugaggcaacuuuaggaggauuuggaucacuaggcuuagacugcgaaccgaggacagguuuagauuuuagugaucuauauuaucuuacuaugaauaauaaacauugguugguacauaaagaaugguuucacgauauaccauuaccauggcaugcaggagcugauacaggaacaccacauuggaauaauaaagaagccuugguugaauuuaaagacgcacaugcaaaacgacaaacaguagugguauuaggaagucaagaaggggccgugcacacagcauuagcuggagcucuagaagcagaaauggauggagcaaaaggaagacuaucaucaggacaccuaaaaugccgguuaaaaauggacaaacuaagacuaaaaggggugaguuacucauuguguacugcagcauuuacauucacaaagauaccagcagaaaccuuacaugguacugucacaguagaaguacaauaugcaggaacagauggaccauguaaaguaccugcacaaauggcaguagacaugcagacauuaacaccaguagguagacuaauaacugcaaaucccguuauaaccgaaucaaccgaaaauaguaaaaugauguuagaauuagauccaccuuuuggggauucauauauagucauaggaguaggagaaaaaaaaaucacucaucauuggcacagaagcggaucaacaaucgggaaagcauucgaagccacaguuagaggagcaaaaagaauggcagucuuaggagauacggccugggauuuuggaaguguagggggggcauuaaauucauugggaaaaggaauacaucaaauauuuggagcagcauuuaaaaguuuguucgguggaaugucaugguuuucucaaauacuaauaggaacucuauuaauguggcuaggucuuaauacaaaaaaugggaguauaucauuaaugugccuagcauuagguggagucuugauauuccuaagcacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7084 - RNA, 2449 nt, Artificial Sequence
  KY075937.1 prME-short mRNA Design 2 opt
ggggcgcugccuacggagguggcagccaucuccuucucggcaucaagcuuaccaugacaaguguaggaauaguuggauuacucuuaacaacagcaauggcagcagaaguaacaagaagggguucagcauauuauauguaucuagaucgaaaugaugcaggagaagcaauaaguuuucccacaacuuugggaaugaacaaauguuauauacaaauaauggacuugggacauaugugugaugcuacuauguccuaugaauguccaauguuagacgaaggaguagaacccgacgauguugauugcuggugcaacacaacaaguacuuggguuguauacggaacaugccaucacaagaaaggagaagcaagaagaucaagacgagcaguaacuuuaccaagucauaguacaagaaaauuacaaacacgaucacagacauggcucgaaucaagggaauauacaaaacaucuaauuagaguagaaaauuggauauucagaaauccaggauuugcauuagcagcugcagcaaucgcauggcuuuuagguucaucgacuucacaaaaaguuauauauuuaguaaugauacuucuaauagcccccgcauauucaauucggugcauuggagucucgaaucgagacuuuguggaaggaaugucagguggaacauggguagauguagucuuagaacauggaggaugcguuacuguaauggcucaagauaaaccuacaguagauauagagcuaguaacaacuacaguaaguaauauggcagaaguaagaaguuauuguuaugaggcaaguauaucugauaugguaucagauucaagauguccaacacagggagaagcauaccuagauaaacagucagauacucaauauguuuguaaaagaacauuaguagaucgaggaugggguaauggcuguggauuauuuggaaaaggaucacuuguaacaugugcgaaauuugcauguucaaagaaaaugacaggcaaaucaauucaaccagaaaauuuagaauacagaauaaugcuaaguguacacgguucacaacauuccggcaugauaguaaacgacacuggacaugaaacugacgaaaauagagcaaaaguugaaauaacaccaaauaguccuagagcagaagcaacauuagguggauuuggaucauugggauuagauugugaacccagaacaggucuggauuuuucagauuuauauuaccuuaccaugaacaauaaacauuggcuagugcauaaagaaugguuccacgacauaccacuaccuuggcaugcaggagcagauacaggaacaccacauuggaauaauaaagaggcuuuaguugaauuuaaagacgcacaugcuaaaagacaaacaguaguaguauuaggaagucaagaaggagcaguacauacagcacuagcuggugcauuagaagcagaaauggacggugcaaaagguagauuaucaucaggacacuuaaaauguagauuaaaaauggauaaacuacgccuaaaagguguaucauauucucuauguacagcagcauuuacauucacaaaaauuccugcagaaacauuacaugguacaguaacaguagaaguacaguaugcaggaacggauggacccuguaaaguaccagcacaaauggcaguagauaugcaaacauuaacaccagucggaagauuaauuacugccaacccaguaauuacagaaaguacagaaaacagcaaaaugauguuagaacuagacccacccuuuggagacucuuauauaguaauagguguaggagaaaagaaaauaacacaucauuggcaucguagugguagcacaauaggaaaagcguucgaagcaacaguaagaggagcaaaaagaauggcuguauuaggugauacagcuugggauuucggauccguaggaggagcacucaacaguuuaggaaaagguauucaccaaaucuuuggagcagcauuuaaaaguuuauuuggaggaaugagcugguuuagucaaauauuaauugguacucuauuaaugugguuaggauuaaauacuaaaaauggaucaauaagucuaaugugccuagcauuaggcgguguacuaauauuucugucuacagcgguuucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7085 - RNA, 2449 nt, Artificial Sequence
  KY003156.1 prME-short mRNA Design 2 opt
ggggcgcugccuacggagguggcagccaucuccuucucggcaucaagcuuaccaugacaucaguugggauugugggucuucuuuuaacaacagcuauggcagcagaaguaacaagaagaggaucagcauacuacauguauuuagaucgaaaugaugcuggagaagcaauaaguuuuccaacuacuuuaggaaugaauaaauguuauauacaaauuauggauuuaggacauaugugugaugcuacuaugagcuaugaauguccaaugcuagaugaaggaguagaacccgacgauguagauugcugguguaacacuacaagcacguggguuguauauggaacuugccaccauaagaaaggagaagcuagaagaaguagacgagcaguaacacuaccuagucauucaacgagaaaacuacaaaccagaucacaaacauggcuagaaucaagagaauauacaaaacaccucauaagaguugaaaacuggauauuuaggaacccaggauuugcucuagcagcagcugcaaucgcaugguuauuaggauccucaacaucacaaaaaguuauauacuuaguaaugauuuuauuaauagcaccagcuuauuccauuagauguauagguauaagcaacagggacuuuguagaaggaaugaguggaggaacuugggucgauguagucuuagaacacggcggaugcguaacuguaauggcacaggauaaaccaacuguagauauagaauuaguaaccacaacuguaucuaauauggcugaaguaagaucauacugcuaugaagcaaguauaucugauauggcaucagacucaagaugcccaacacaaggagaagccuauuuagacaaacaaagugauacacaauacguauguaaaaggacauuaguagauagaggauggggaaauggcugcggauuauuugguaaaggaagucuaguaacuugugccaaauucgccuguucaaagaaaaugacaggaaaaucaauucaacccgaaaaucucgaauaucguauaauguugucaguacacggaucacaacauaguggaaugauaguuaacgacacuggccacgaaacggacgaaaaucgagcaaaaguagaaauaacaccaaauaguccuagagcagaagcgacauuaggaggauuuggcauauuaggauuagauugugaaccaagaacuggacucgauuuuucagauuuauacuauuugacaaugaauaauaaacacugguuaguacacaaagaaugguuucaugacauaccuuuaccguggcaugcaggagcagacacaggaacgccucacuggaacaauaaagaagcauuaguggaguucaaagaugcacacgcaaaaagacaaacaguaguaguauuagguagucaagaaggagcaguacauaccgcacuagcuggcgcuuuagaagcagaaauggauggcgcaaaaggaagauuaucaagcggacauuuaaaauguaggcuaaaaauggauaaacuaagauuaaaaggaguaagcuauagcuuaugcacagcagcauucacauuuacaaaaauaccagcagagacauuacaugguacaguuacuguagaaguccaauaugcagguacugauggaccauguaaaguaccggcacaaauggcaguagacaugcaaacauuaacaccuguugguagacuaaucacagcaaauccuguaauaacagaaucaacagaaaacucgaaaaugauguuagaauuggacccuccauuuggagacucauauauugucauaggaguaggagaaaagaaaauaacucaucauuggcauagaucaggaucaacaauaggaaaagcauuugaagcaacagugagaggagccaaaagaauggcgguucuuggagacacagcuugggauuuuggaucuguaggaggagcauuaaauaguuuaggaaaaggaauacaucaaauauuuggcgccgcuuuuaaaagccuuuuuggaggaaugucaugguuuagucaaauacugauagguacgcuauuaauguggcuugguuugaauacgaaaaauggaaguauaaguuuaaugugucuggcacuuggagggguauuaauauucuuaucaacagcagugucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7086 - RNA, 2449 nt, Artificial Sequence
  KU312313.1 prME-short mRNA Design 2 opt
ggggcgcugccuacggagguggcagccaucuccuucucggcaucaagcuuaccaugaccaguguagggauaguaggauuacuauuaacuaccgcaauggccgccgaaguaacaagaagaggcagugcauauuacauguacuuagacaggaaugacgccggugaagcuauaaguuuuccaacaacuuuaggaaugaauaagugcuauauucaaauaauggacuuaggacauacgugugaugcaacaaugucauaugaauguccgauguuggacgaaggaguagaaccagaugauguagauuguugguguaacacaacgaguacauggguuguauauggaacuugucaucacaagaaaggagaagcaagaagaagcagacgagcaguaacccuucccucucacaguauaagaaaacuacaaacaaggagccaaacauggcuagaaaguagagaauauacaaaacaucugauuagaguugaaaauuggauauucagaaauccuggauuugcguuagcagcggcagcaauagcaugguuauuagguaguucaacaagucaaaaaguaauuuaccuaguaaugauauuacuaauugcaccagcauacucuauaaggugcaucggaguaucaaauagagauuucguagaagguaugucaggaggaacauggguagacguaguguuagaacaugguggauguguaacuguaauggcgcaagauaaaccaacaguggauauagaacugguaacaacuacuguaagcaauauggcagaaguacgaucguauuguuaugaggccaguauaucugauauggccagugacaguagaugcccaacacaaggugaagcauaccuagacaaacaaucagacacucaguauguuuguaaacgaacauuaguagaucgagguugggguaauggauguggguuauucggaaaaggaaguuuaguaacuugugcaaaauuugcauguucaaagaaaaugacaggaaaaucaauacaaccagaaaaucuagaauauagaauaauguuaucuguacaugguagccaacacagcggaaugauuguuaacgacacaggacaugaaacggaugaaaauagagcgaaaguugaaauaaccccaaauagcccaagagcagaagcaacuuuagguggauuuggaucauuagguuuagauugugaaccaagaaccggacuagacuuuagugaccuauauuauuuaacaaugaauaauaaacauugguuaguacauaaagaaugguuucacgauauaccacucccauggcacgccggagcagauacagguacaccacacuggaauaauaaagaagcauuaguagaguucaaagaugcgcacgcaaaaagacaaacuguugugguucuaggaagucaagaaggcgcaguucauacugcauuagcgggagcacuagaggccgaaauggacggagcaaaaggaagacuuagcucaggucaucuaaaaugcagauuaaaaauggauaaacuccgauuaaaaggaguaucauacaguuuauguacagcagcauuuacauuuacaaaaauaccagcagaaacucuacauggaacugugacaguagaaguacaauacgcggguacugacggaccuuguaaaguaccagcucaaauggccguggauaugcaaacauuaacaccaguuggaagauuaauuacagcuaacccaguaauaacugaaucaacagaaaacagcaaaaugauguuagaauuagacccgccauuuggagacaguuauauaguaauuggaguaggcgaaaagaaaauaacucaucacuggcaccgaucaggaucaacaauagguaaagcauuugaagcaacuguucgaggagcaaaaaggauggcaguacuaggcgauacagcgugggauuuuggaucuguaggaggugccuuaaauucuuuaggaaaagguauacaccaaauuuuuggagcagcauuuaaaucacuauuugguggaaugagcugguucucacaaauauuaauaggaacacuauuaauguggcuuggucuaaaugcuaaaaaugguaguauaaguuuaauguguuuagcauuaggaggaguacuaaucuuccuaagcaccgcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7087 - RNA, 2449 nt, Artificial Sequence
  KY075935.1 prME-short mRNA Design 2 opt
ggggcgcugccuacggagguggcagccaucuccuucucggcaucaagcuuaccaugacauccguagguauaguaggauuacuacuaacaacagccauggccgcagaaguaacccgucgaggaucugcauacuauauguauuuagaccgaaacgacgcaggagaagcuauauccuucccaacaacucuaggaaugaauaaauguuauauucaaauaauggauuuaggacauaugugcgaugcaaccaugucauaugaauguccaauguuagaugaagggguagaaccagaugauguagacugcugguguaauacaacuuccacauggguuguauacggaacgugucaucauaagaaaggagaagcgcaaagaaguagacgagcaguuacacuaccaagucauaguacaagaaaauuacaaaccagaucucaaacauggcuagaaucaagggaauacacuaaacaucuaauaagaguagaaaauuggauuuuuagaaauccuggauuugcacuagcggcagccgcaauagcauggcuauuaggaaguucuacaucacaaaaaguaauauacuuaguaaugauacuauuaauagcaccagcuuacaguaucagaugcauaggaguuucaaacagagauuucguagaaggcaugaguggaggaacauggguugauguaguacuagaacaugguggaugcguaacaguaauggcacaagacaaaccaacaguagauauugaauuaguaacaacaaccguaucaaauauggcugaagucagaaguuacuguuaugaagcuagcauaagugauauggcaagugauucaaggugcccaacacaaggugaggcuuaucuagacaaacaaagugacacacaauauguauguaaaagaacuuuaguagaccgaggauggggaaauggauguggauuauucggaaaaggauccuuaguaacuugcgcuaaauuugcguguucaaagaaaaugacagguaaaaguauacaaccagaaaauuuagaauauagaauaaugcuaucaguacacggaagccaacauucaggcaugauaguaaacgauaccggacaugaaaccgacgaaaacagagcaaaaguugaaauuacacccaacagcccccgagcagaagcaacccuuggagguuuuggcagcuuaggauuagauugugaaccaagaaccggauuagauuuuagugaccuauauuaucuaacaaugaauaauaaacauugguuaguacacaaagaaugguuucacgacauaccauuaccauggcaugcaggagcagacacuggaacaccacauuggaauaauaaagaagcauuaguagaauuuaaagaugcucaugcaaaacgacaaacaguaguaguauuaggcagucaagaaggggccguacauacagccuuagcaggggcacucgaagcagaaauggacggagcuaaaggaagacuaucaaguggucauuuaaaaugucgcuuaaagauggauaaauugagauuaaaaggaguaaguuauucacuauguacagcugcauuuacauucacaaaaauaccagcagaaacacuucauggaaccguaacaguagaaguacaauaugcagggacagauggaccauguaaaguaccugcacaaauggcaguugauaugcaaaccuuaacaccaguaggaagacuaauaacagcaaauccaguaauaacagaaucgacagaaaauaguaaaaugauguuagaauuagacccacccuuuggagacucauauauagugauagguguaggugaaaagaaaauaacucaccauuggcauagauccggaaguacaauaggaaaagcauuugaagcaacaguaagaggagcgaaacguauggcuguacuaggagauacagcaugggauuuuggaucaguaggaggagcacuaaauagccuuggaaaaggaauacaccagauauuuggagcagcauuuaaaucuuuauuuggaggaaugucaugguucagucaaauauuaauagguacauuacuaaugugguuagguuuaaacacuaaaaauggaucuauaucuuuaauguguuuagcauuagggggaguuuuaauauuucuaucaacagcuguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7088 - RNA, 2449 nt, Artificial Sequence
  KY014320.1 prME-short mRNA Design 2 opt
ggggcgcugccuacggagguggcagccaucuccuucucggcaucaagcuuaccaugacuuccguagguauaguagguuuacuauuaacaacugccauggccgcagaaguaacuagaagagguagcgcauauuauauguacuuagaucgaaacgaugccggagaagcaauaucauucccaacaacauuaggcaugaauaaauguuauauacaaauaauggauuuaggacauaugugugaugcaacaaugucauacgaauguccgaugcuagacgaagguguagaaccagacgauguagacuguugguguaacacaacuuccacauggguuguuuauggaacuugucaucauaaaaaaggagaagcaagacguucacguagagcuguaacccuaccaucacauucaacaagaaaacuucaagcaagaucacaaacauggcuagagucuagagaauacacaaaacauuuaauaagaguagaaaacuggauauuuagaaauccgggauucgcuuuagcugcagcagcaaucgccuggcuauuagguucaagcacaagucaaaaaguaauauacuuagucaugauauuauugauagccccagcuuauucaauaagauguauaggaguuucaaacagggauuuugucgaaggaaugucaggaggaacauggguagaugucguauuagaacacggaggauguguaacaguaauggcacaagauaaaccaacaguugacaucgaauuaguuacaacgacaguaagcaauauggcugaaguaagaucuuauuguuaugaagcaagcauuagugacauggcaagugauucaaggugcccaacacaaggagaagcuuauuuagacaaacaauccgauacucaauacguauguaaaagaacauuaguggauagaggauggggcaauggauguggccuauuugguaaaggaaguuuaguaacuugugcaaaauuugcauguaguaaaaaaaugacagguaagagcauacaaccagaaaaucuagaauaucgaauaauguuaucuguucauggcagucaacacucaggaaugauaguaaaugacacaggacaugaaacugaugagaauagagcaaagguagaaauaacaccaaacagcccaagagcugaagcaacauuaggaggguuuggaucauuaggacucgauugugaaccaaggacuggcuuagacuuuucagauuuauauuauuuaacaaugaauaauaaacauuggcuaguacacaaagaaugguuucaugauauuccgcuaccauggcacgcaggagcagauacgggaacuccccauuggaauaauaaagaagccuuaguagaguucaaagacgcacacgcaaaaagacaaacagucguaguacuuggaagucaagaaggagcaguacauacagcuuuagcaggggcucuugaagcagagauggacggagcaaaaggaagacugucaagcggacaucuaaaaugcagauuaaaaauggauaaacuaagauuaaaaggaguaucuuacagucuuugcaccgcugcuuuuaccuuuacaaaaauaccagcagaaacuuuacauggaacuguuaccguagaaguccaguacgcuggaacagauggcccaugcaaaguacccgcacagauggcuguagauaugcaaacauuaacaccaguagguaggcugauaacagcaaaucccguaauaacagaaucaacagaaaauucaaaaaugaugcuagaacuugacccaccuuuuggcgauaguuauauaguuauaggaguaggagaaaaaaaaauaacacaucauuggcacagaucugguuccacgaucggaaaagccuuugaagcaacaguaaggggagcgaaaagaauggcuguacuaggugacacagccugggauuucggaucaguuggaggugcacuaaauucauuaggaaaaggaauacaccaaauuuuuggagcagcauuuaaaucauuauucggcggaaugagcugguuuucacagauuuuaauaggaacacuauuaauguggcuaggacuaaauacaaaaaauggaucgauaagucuaaugugucuagcacuaggaggaguauugauauuucuaucaacggcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7089 - RNA, 2449 nt, Artificial Sequence
  KY328290.1 prME-short mRNA Design 2 opt
ggggcgcugccuacggagguggcagccaucuccuucucggcaucaagcuuaccaugacaucaguaggcauaguaggacuauuacuaacaacagccauggcagcggaaguaacaaggagaggaucugcauauuacauguacuuagaucgauccgaugcaggagaagcaauaaguuuuccaacaacuuuagguaugaauaaauguuauauacaaauaauggauuuaggacacaugugugaugcuacuaugucuuaugaaugcccaauguuagacgaaggaguggaaccugaugauguugauuguugguguaauacaacaaguacauggguaguauaugguacaugucaucauaagaaaggagaagcgaggagaucaaggagagcuguaacauuaccaagucauagcacaagaaaauuacaaacaagaagccaaacuugguuagaaaguagagaauacacaaagcauuuaauaagaguagaaaauuggauauuuagaaacccaggauuugcacuagcagcagcagcaauagcauggcuauuaggcaguaguaccucacaaaaagucauauauuuaguuaugauacuuuuaauagccccugcauauagcauuagauguauaggcguuagcaaucgagauuuuguagaagguaugucaggagguacuuggguagauguaguauuagaacacgggggaugugucaccguaauggcccaagacaaaccaacuguagauauagaguuaguuacuacaacaguaagcaauauggcagaagucagaaguuauugcuacgaagcaagcauaagcgauauggcuagugauagccgauguccuacccaaggagaggcguauuuagauaaacaaucugacacgcaauauguauguaaaagaacucuaguagacagaggauggggcaacggaugcggauuauuuggaaaagguagcuuaguaacaugugcaaaauuugcauguucaaagaaaaugacuggaaaaaguauucaaccagaaaacuuagaauaucgaauaaugcuaucaguacauggaagucaacauucaggaaugauaguaaacgacacuggacacgagacagaugaaaaucgagcgaaaguagaaauaacaccaaauucaccuagagcugaagcaacauuagguggauuugguagcuuaggauuagauugugaaccaagaaccggucuagauuucagcgaccuauauuauuuaacaaugaauaauaaacacuggcuaguacauaaagaaugguuucaugauauuccucuaccuuggcacgcuggagccgacacuggaacaccucauuggaacaauaaagaagcguuagucgaguucaaagaugcccacgcaaaaagacaaacuguaguaguauuaggaucacaagaaggagcaguacauacagcacuagcaggagcacuagaagcagaaauggauggagcaaagggaagauuaagcaguggacaccuaaaauguagacuaaaaauggacaaacuaagauuaaaaggaguuucuuauagucuaugcacggcagcuuucacauuuaguaaaauuccagcugaaacauuacauggcacaguaacagaagaaguccaauaugcagguacugauggaccauguaaaguaccagcacaaauggcaguagauaugcagacacuaacacccguagguaggcuuauaacagcgaauccaguaauaacugaaaguacugaaaauaguaaaaugauguuagaauuagaucccccauuuggugauucauacauaguaauaggaguaggagaaaagaaaauuacacaucauuggcaccguucaggaucaacaaucggaaaagccuuugaagcaacuguuagaggagcaaaacgaauggcaguuuuaggagauacugcaugggauuucggaaguguaggaggggcauugaauagcuugggaaaagguauucaucaaauauucggagcagcauuuaaaagucuauuuggugguaugaguugguuuagucaaauacuaauuggaacauuacuaauguggcuagguuuaaauacgaaaaacggaucaaucaguuuaaugugccuagcucuaggcggcguccuaauauuuuugaguacagcaguuuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7090 - RNA, 2449 nt, Artificial Sequence
  KU681081.3 prME-short mRNA Design 2 opt
ggggcgcugccuacggagguggcagccaucuccuucucggcaucaagcuuaccaugacaucuguaggaauaguaggacuacuacuaacuacagccauggcugcagagguaacaagaagaggaucagcauauuauauguauuuggauaggucagaugccggugaagcaauaaguuuuccuacuacauuaggaaugaacaaauguuauauacaaauaauggauuuaggacauaugugugaugcaacaaugaguuaugaaugcccgaugcuagaugaaggagucgaaccagaugaugucgauuguuggugcaacacaacaucaacguggguugucuauggaacaugucaccacaagaaaggugaagcuagaagaucaaggagagcaguuacauugcccagucauaguacaagaaaauuacaaacaagaagucaaacaugguuagaaaguagagaauauacuaaacaucuaauacguguggaaaauuggauauuuagaaauccaggauuugcgcuagcagcagcagcaauagcaugguuacuagguucuaguacaagucaaaaaguaauauaucuagugaugauauuauuaauugcacccgcauauaguauaaggugcauaggugucagcaauagagauuuuguggaaggaaugucuggaggaaccuggguugauguaguuuuagaacaugggggaugcguuacaguaauggcacaggauaaacccacaguugauaucgaauugguuacgacaacaguuaguaacauggcagaaguaagaucauacuguuaugaagcaaguauaucagauauggcaucagauucaagauguccaacccaaggagaagcauauuuagacaaacaaagugauacccaauacguauguaaacgaacucuuguagauagaggauggggaaacggauguggauuauuuggaaaagguagucuaguaacuugcgcaaaauuugcuuguucaaagaaaaugaccggaaaaucaauacaaccagaaaacuuagaauauagaauuaugcuaaguguacauggaucucagcacagcgggaugauaguuaacgacacaggucaugaaacagacgaaaauagagcaaaaguagaaauaacaccaaacaguccaagagcagaagcaacccuugguggauuugggaguuuaggucuggauugcgaaccgagaacaggauuagauuuuagugauuuauauuaucuaacaaugaauaauaaacauugguuaguacauaaagaaugguuccaugauauaccacuuccauggcauacgggagcagacaccggaaccccacauuggaacaauaaagaggcauuaguugaauuuaaagacgcacacgcaaaaagacaaacaguaguaguacugggcucccaagaaggagcaguacauacagcacuagcgggugcacucgaagcagaaauggauggagcgaaaggaagauuaagcaguggccaucuaaaauguagguugaaaauggacaaacuaagguuaaaaggaguaaguuacagccucuguacagcugcuuucaccuuuacaaaaauaccggcagaaacauuacacggaacaguaacaguagagguucaauaugcaggaacagauggaccauguaagguuccagcacaaauggcagucgauaugcaaacauuaacuccaguuggaagauuaauaacagcaaauccuguuauaacagaaggaacagaaaacucaaaaaugauguuagaacuagauccaccauuuggcgauaguuauaucguaauaggaguaggggaaaagaaaauaacucaucacuggcauagaagcggaucaaccauagguaaagcauuugaagcaacgguaaggggugcaaaaagaauggcaguauugggagacacagcuugggacuuuggaaguguaggagguguauuaaacagucuaggaaaaggaauacaucaaauauuuggagcagcauuuaaaaguuuauuuggaggaaugagcugguuuucacaaauauuaauaggaacauuacuuaugugguugggacuaaauacuaaaaauggaucgauaagccugauguguuuagcacuagguggaguuuuaaucuuccuaaguacagcaguaagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7091 - RNA, 2449 nt, Artificial Sequence
  KX827309.1 prME-short mRNA Design 2 opt
ggggcgcugccuacggagguggcagccaucuccuucucggcaucaagcuuaccaugacaucaguaggaauaguaggauuacuacuaaccacagcaauggcagcagagguaacaaggagaggaucagcauauuauauguauuuagaucgaucagacgcaggagaagcaauaaguuuuccaaccacgcuaggcaugaauaaauguuacauucaaauaauggacuuaggucauaugugugaugcaacaauguccuaugaauguccuauguuagaugaaggaguugaaccugaugauguugauuguugguguaacacaacaucaacuuggguaguauaugguacaugucaccauaaaaaaggagaagcuagacgaaguagaagagcuguaacacuaccaagccacucgacuagaaaacuacaaacaagaucacaaacaugguuagaaaguagagaauacacaaaacaucuuauacgaguagagaauuggauauuucgcaauccaggauuugcacuagcagcagcagcaauagcgugguuauuagguucaucuacaagccaaaaaguaauauauuuaguaaugauauuauuaauagcaccagcguauucaauaagauguauaggagucaguaauagggauuucguagaaggaaugucuggcggaacauggguagauguaguacuagaacauggaggaugcguaacaguaauggcucaagauaaaccaacuguugauauagaauuaguaacaacaacaguaagcaauauggcagaaguaagaucauacuguuaugaggcaaguauaagugauauggcaucagauagcagaugucccacacaaggcgaagcauaucucgacaaacaaagcgacacgcaauauguauguaaacgaacucuaguagauagagguugggguaacggcuguggacuauuuggaaaaggaaguuuaguaaccugcgcuaaauucgcauguucaaaaaaaaugacgggaaaaucaauacaaccagaaaacuuagaauauagaauaauguuaagcguacauggcagucaacacucaggaaugauaguaaaugauacaggucaugagacugacgaaaaccgagccaaaguagaaauaacuccaaauucaccaagagcugaagcaacacuuggagguuuuggcaguuuagguuuagacugugaaccaagaacaggacuagacuuuuccgaucuauauuaccuaacaaugaacaauaaacauugguuaguacauaaagaaugguuucaugacauaccauuaccuuggcaugcaggagcagauaccggaacaccucacuggaauaauaaagaagcacuaguugaauucaaagaugcacaugcuaaaagacaaacugucguuguacuagguagucaagaaggagcaguucauaccgcacuagcgggagcacuugaagcagaaauggacggggcaaaaggaagauuaagcucaggacauuuaaaaugcagacuaaaaauggauaaacuaagacuaaaaggagucucauauaguuuauguacagcagcguuuacauuuacaaagauuccagcagaaacauuacauggaacaguaacuguagaaguacaguaugcaggaacugacggaccauguaaaguuccagcacaaauggcuguugauaugcaaacuuuaacuccaguaggaagauugauuacagcaaaucccgugauaacagaauccacagaaaauucuaaaaugauguuagaacucgaucccccguuuggagauagcuauauaguaauaggaguaggagaaaaaaaaauaacacaccauuggcacaggucagguuccacaauagguaaagcuuuugaagcuacaguaagaggagcuaaaagaauggcuguacuaggagauacagcaugggauuuuggaagcguaggcggagcacuuaauucauuaggaaaagguauccaccaaauauucggagccgcuuucaaaucuuuauuuggaggaaugaguugguuuagccaaauauuaauaggcacucuacuaaugugguuaggacuaaacacuaaaaauggaucuauaucauuaauguguuuagcauuaggcggaguucuaauuuuucucucaacagcaguaucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7092 - RNA, 2449 nt, Artificial Sequence
  KU955593.1 prME-short mRNA Design 2 opt
ggggcgcugccuacggagguggcagccaucuccuucucggcaucaagcuuaccaugacaucaguaggaauaguuggauuauuauuaacaacagcaauggcaguagaaguaacuagaagaggaaaugcauauuacauguacuuagaucgaucagaugccggugaagcgauuagcuuuccaacaaccaugggaaugaacaaaugcuacauacaaauaauggaccuaggccauaugugcgacgcuacaaugucauacgaauguccuauguuagaugagggaguagaaccugaugauguugacuguugguguaauacaacaaguacuuggguaguauauggaacaugccaucauaagaaaggagaagcaaggagaucaagacgagcaguaacacuuccaagccauucaacuagaaaacuucaaacaagaucucaaacguggcuagaaucaagagaauauacaaaacacuuaauaagaguagaaaauuggauuuuccgaaauccaggcuuugcauuagcagcagcugcaauagcuugguugcuaggaaguucaacaucacaaaaaguaauuuaccucguaaugauauuauuaauagcacccgcauacucaauucgaugcauaggaguaaguaacagagacuuugucgaagguaugucaggagggacuuggguagauguaguacuagaacauggagguugcguaacaguaauggcucaagauaaaccaacaguagacauagaauuagucacuacaacgguaucaaacauggccgaaguacgaucauauuguuaugaagcaucaauaucagacauggccagugacuccagauguccaacacaaggugaagccuaucuagauaaacaaagugauacgcaauauguauguaaacgaacacuuguagacagagguuggggaaacggcugcgguuuauuugguaaaggaaguuuaguaacaugugccaaauuugcauguuccaagaaaaugacagguaaaagcauacaacccgaaaauuuggaauaucgaauuauguuaucaguacacggaucacaacacucagguaugauagucaaugauacuggucacgaaacugaugaaaauagagcaaaagucgaaauuacacccaauucgccuagagcugaagcaacguuaggaggauuuggcucauuaggauuagauugcgaaccaagaacaggucucgauuucucagacuuauauuacuuaaccaugaauaauaaacauuggcucguucacaaagaaugguuucaugauauaccucuacccuggcaugcaggagcagauaccgguacaccacauuggaauaacaaagaagcgcuaguagaauuuaaagacgcacaugcaaaacgacaaacuguaguaguuuuaggaucacaagaaggagcaguacauacugcauuagcuggagcauuagaagcagaaauggauggagcaaaaggaagguuaaguaguggucauuuaaaauguagauuaaaaauggauaaguuaagacuaaaaggagugaguuauucacuaugcacagccgccuuuacauuuacuaaaauuccagcagaaacauugcauggaacagucacaguggaaguacaauacgccggaacagacggaccaugcaaagucccagcacaaauggcaguagauaugcaaacauuaaccccaguaggaagacuaauaacagcaaauccuguaauaacugaaucaacggaaaauucaaaaaugauguuggaauuagauccaccauuuggcgauucauauauaguuauaggcgucggagaaaagaaaauaacccaucauuggcacagaucagguucaacaauaggaaaagcauuugaggccacgguaagaggcgcaaaaagaauggcaguauuaggagacacagcaugggauuucggaagcguuggaggagcacucaauagcuuagguaaaggaauccaucaaauuuuuggagcagcguucaaaucauuauuugguggaaugucaugguuuucacaaauauuaauaggaacuuuauuaguaugguuaggacuaaauacuaaaaacggaucuauaagccuaauguguuuagcacucggaggaguauuaauuuuccuaaguacagcaguuagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7093 - RNA, 2449 nt, Artificial Sequence
  KY272987.1 prME-short mRNA Design 2 opt
ggggcgcugccuacggagguggcagccaucuccuucucggcaucaagcuuaccaugacaucaguaggaauaguuggucuauuauugaccacagcaauggcugccgaagugacaagaagagguucagcauauuauauguaucuugaucggucugaugcaggagaagcgauaaguuuuccaacaacucuaggaaugaacaaauguuauauacaaauaauggaccuagggcauaugugugacgcaacaaugaguuaugaauguccaaugcuagaugaaggaguagaaccagacgauguugacuguugguguaauaccaccaguacauggguaguauauggcacaugucaucauaaaaaaggagaagcgcgacguaguagacgcgccguaacacucccaucacauucaacaagaaaacuucaaacaagaagccaaaccugguuagaaaguagagaauacacaaaacaccuuauaagaguagaaaacuggauauuuagaaauccaggcuucgcauuagcagcugcagcaaucgcaugguuacucggaucaucaacaucccaaaaaguaauauaucuagugaugauacuauuaaucgcaccagcauacucaauaagauguauaggaguaaguaacagagauuuuguugaagguaugaguggggggacauggguagauguaguacuagaacauggcggaugcguaacagucauggcucaagauaaacccacaguagauauagaacucguaacaacaacaguaucaaacauggcagaagucagaucauauuguuaugaggcaaguauaagugacauggcaucagacaguagguguccaacccaaggagaagcuuaucuagacaaacaaagugauacccaauauguauguaaaagaacuuuaguagacagaggauggggaaauggaugcggauuauuuggaaaagguucguuaguaacgugcgcaaaauucgcauguagcaaaaaaaugacugguaaaucaauacaaccagaaaaucuagaauacagaauaaugcucucugugcacgguagucaacauucuggaaugauaguaaaugauacaggacaugaaacggaugagaacagagcaaaaguagaaauaacaccaaacaguccaagagcagaagcaacacuaggggguuucgguucuuuaggauuagauugugaaccaagaacaggacuagauuuuagcgaucuauauuauuuaacaaugaacaacaaacauugguuaguacauaaagaaugguuucaugauauaccacucccauggcaugcaggcgccgauacaggcacaccacauuggaauaacaaagaagcacuaguggaauuuaaagaugcacacgccaaaagacaaacuguaguaguacuaggaucacaagaaggagcuguacauacagcauuagcaggugcacuagaggcagaaauggauggagcaaaaggaagauuaucuagcggccaucuaaaaugcaggcuaaaaauggauaaauuaagacuaaaaggagugucauacucucucuguacugcagcauucacuuuuacaaaaauacccgcagaaacguuacacggaacuguaacagucgaaguucaauaugcaggaacagauggaccauguaaaguaccagcacaaauggcaguagauaugcaaacuuuaacuccaguuggccgacuaauuacagcaaauccaguuauuacagagucaacagaaaauagcaaaaugaugcuagaauuagacccaccauucggagauucauauauagucauaggggucggagaaaaaaaaauuacgcaucacuggcacagaagcggaucaacaauaggaaaagcuuucgaagcgacaguaagaggagcaaaaagaauggcaguuuuaggggauacagcaugggacuuuggauccgucgguggagcacuaaauagucuaggaaaaggaauacaucaaauauucggagcggccuuuaaaucgcuauuuggaggcaugucaugguuuagucaaauucuuauagguacuuuacuaaugugguuaggguuaaauacgaaaaacgggucaauaaguuuaguauguuuagcucuaggaggagugcucauauuccuaucaacagcgguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7094 - RNA, 2449 nt, Artificial Sequence
  KY007221.1 prME-short mRNA Design 2 opt
ggggcgcugccuacggagguggcagccaucuccuucucggcaucaagcuuaccaugacaaguguaggaauuguaggauuauuacugacaacugcuauggcagcagagguuacaagaagaggaagcgcauauuauauguaucuagauagaucagaugcuggugaagcaauuucuuuuccaacaacauuaggaaugaauaaauguuacauacaaauuauggauuuaggacauaugugugacgcuaccaugaguuaugaauguccaauguuagaugaaggaguugaaccagaugacguagauuguugguguaauacaacaucaacauggguaguauaugggacaugccaucauaagaaaggagaagcaagacgaaguagacgagcuguaacauugccaucacauucaacaagaaaauugcaaacuagaucacaaacuuggcuagaaaguagagaauauacaaaacauuuaauccgaguagagaauuggauauuccgaaauccuggauuugcauuagcagcagcagcaauagcguggcuucucgguaguucaacaucacaaaaaguuauauacuuggucaugauauuauuaauagcuccggcauauagcaucagauguaucggaguaaauaaucgagauuucguagaaggaaugucagguggaacguggguagauguaguauuagaacacgguggauguguaacuguaauggcacaagauaaaccaacuguugauauagaacucguaacaacgacaguaaguaauauggcggaaguacgaaguuauuguuaugaagcauccauaucugauauggcaucagacagcagauguccaacccaaggagaagcauaccuggauaaacaaucagauacgcaauauguauguaaaagaacuuuaguugacagaggauggggaaauggaugcggcuuauucggcaaaggaaguuuaguaacaugcgcaaaauuugcguguaguaagaaaaugacaggaaaaagcauacagccagaaaaccuagaauauaggauaauguugaguguacauggcagucaacauaguggaaugauagucaaugauacuggccacgaaacagaugaaaauagggcaaaaguagaaaucacaccaaauagcccucgagcagaagcaacauuaggaggauuuggaucuuuaggucuagauugugaaccaagaacaggcuuagauuuuucagacuuauacuaucuuacaaugaauaacaaacauuggcuaguacauaaagaaugguuucacgauauaccacuaccuuggcaugcaggagcagacacuggaacaccacauuggaauaacaaagaagcacucguagaauuuaaagacgcacaugcaaaaagacagacagugguaguuuuaggaucacaagagggagcaguacauaccgcauuagcaggagcucucgaagcugaaauggauggagcaaaaggaagauuaucaagcggacauuuaaaaugcagacuaaaaauggacaaauuaagauuaaaagguguaaguuacagucuauguacugcagcauuuacauucacuaaaauaccagcggaaaccuuacauggaacgguaacaguagaagugcaguacgcugguacggauggacccuguaaagucccugcacaaauggccguagauaugcaaacucuaacaccuguaggacgacuaauuacagcuaauccaguaauaaccgaaagcacagaaaacucuaaaaugauguuagaauuagauccuccuuuuggagauucauacauuguuauaggaguaggcgaaaagaaaaucacacaccauuggcauagauccggaaguacaauaggaaaagcauuugaggccacaguaagaggcgcaaaaagaauggcaguacuaggagacacagccugggauuuugguucuguaggaggagcauuaaacaguuuaggcaaaggaauacaucagauuuucggagcagcauuuaaaucauuauucgggggaaugaguugguuuucacaaauacuuauaggaacacuacuaauguggcuggguuuaaauacuaaaaauggaagcauaucccuaguuugccuagcacuaggaggaguucugauauuucuaucaacagcuguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7095 - RNA, 2449 nt, Artificial Sequence
  EU545988.1 prME-short mRNA Design 2 opt
ggggcgcugccuacggagguggcagccaucuccuucucggcaucaagcuuaccaugacgucaguaggaauaguaggguuacuuuuaacgacagcaauggcaguagaaguaacacgaagaggauccgcauauuacauguaucuugaccgaucagaugcaggagaagcaauaaguuucccaacaacacuaggaaugaauaaaugcuauauacaaauaauggauuuaggucacaugugcgaugcaacaauguccuaugaauguccgauguuagaugaagguguggaaccugaugauguagauuguugguguaauacuacaucuacauggguugucuacggcacaugucaucauaagaaaggagaagcgcgaaggaguaggagagcaguaacacuaccgucacacagcacaagaaaauuacaaacuagaucacaaaccugguuggaauccagagaauauacaaaacauuuaaucagaguagaaaauuggauauuuagaaauccaggguuugcuuuagcagcagcagcaauagcaugguuauuaggaaguucaacuagccaaaaaguuaucuaccuaguaaugauucuauuaauagcaccagcguauucaauaagauguauagggguaaguaauagagacuucguagaaggaaugaguggaggaacuuggguagacgugguauuagaacauggaggaugcguaacagugauggcacaagacaaaccagcaguagacauagaauuaguaacaacaacaguaagcaauauggcagaaguaagauccuauuguuaugaagcaucaauaucagauauggcaagcgacucgagauguccgacacaaggagaggcuuaucuagacaaacaaagcgauacccaauauguaugcaaaagaacauuaguagauagaggaugggguaaugguugcggauuauucggaaaaggaucucuagucacaugugcuaaauucgcauguucaaagaaaaugacaggcaaaaguauacaaccagaaaauuuagaauacagaauaauguuaagcguucauggaagucaacauaguggaaugauaguaaacgauacgggacacgaaacggaugaaaauagagcgaaaguggaaauaacaccuaauucaccaagagcagaagcuacacuagguggauuuggaucucuaggacuggacugugaacccaggacaggucuagauuuuagcgaccuauauuacuuaacgaugaauaauaaacauuggcuaguucauaaagaaugguuucaugacauaccauuaccauggcaugcuggagccgacacagguacaccacauuggaauaauaaagaagcauuaguagaguucaaagaugcucaugccaaaaggcagacaguuguuguacuagggucacaagaaggagcaguacauacagcucuagcgggagcacuagaagcagaaauggauggagcaaaagggcgauuaagcucuggacauuuaaaauguagauuaaaaauggauaaauuaagauuaaaaggaguaaguuauucauuaugcacagcggccuuuacauucacaaaaauaccagcagaaacacuacaugggacagugacaguagaaguucaauaugcaggaacagacggaccuugcaaaguuccggcacaaauggcaguugauaugcaaacacuaacaccagugggaagauuaauaacagcaaacccaguuauaacagaaaguacagaaaauagcaaaaugaugcuggaauuagauccaccauuuggugacaguuacauaguuauaggagugggagaaaagaaaauaacacaucauuggcauagaucugggagcacaauuggaaaagcguucgaagccacaguaaggggugcaaaaagaauggcaguauuaggagauacugcaugggauuuuggaucaguagggggugcuuuaaauucauuaggaaaaggaauacaucaaauuuucggugcagcauuuaaaaguuuauuuggaggaaugucaugguucagucaaauccucauuggaaccuuauuagucuggcugggauuaaauacuaaaaacgguucuauaaguuuaaccugucuagcacuaggaggcguauuaauuuucuuaagcacagcaguuagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7096 - RNA, 2449 nt, Artificial Sequence
  KU681082.3 prME-short mRNA Design 2 opt
ggggcgcugccuacggagguggcagccaucuccuucucggcaucaagcuuaccaugacgucaguagggauagucggauuauuauuaacaacugcuauggcaguugaaguuacaagaagaggaagugcauacuauauguaucuugauagaucagaugcgggugaagcaauaucauuuccuacuacacuuggaaugaacaaauguuauauacaaauaauggaucuaggacauaugugugaugcaacaaugagcuacgaauguccgauguuagacgaaggaguagagccagacgauguagauuguugguguaacacaacaucaacaugggucguuuauggaacgugucaccacaaaaaaggagaagcaagaagaucgcgaagagcaguuacacuaccaagccauaguaccagaaaacuacaaaccagaucacaaacauggcuagaaucacgugaauauacaaaacaucuaauacgaguugaaaauuggauauuuagaaauccagguuuugcacuagcagcagcaguaauagcauggcuacuaggaucgucaacaagucaaaaagucauauacuuagucaugauccuacuaauagcaccagcuuacuccauaagauguauaggaguaagcaacagggauuuuguugaagguaugaguggcggaacauggguugauguuguacuagaacacggggguuguguaaccguuauggcacaagacaaaccaacaguagacauagaacugguaacaacaacaguaucaaauauggcagaaguucgaaguuauuguuaugaagcaaguauuagcgacauggcuagugauucaagauguccaacacaaggugaagcauauuuagauaaacaaucugauacacaauacgucuguaaaagaacacuugucgacagaggauggggaaauggaugugguuuauuuggaaaaggaagccucguaacuugugcuaaauuugcauguaguaaaaaaaugacgggaaaaaguauacaaccagaaaauuuagaauauagaauaauguuaagugugcacggaucacagcauucagguaugauuguaaacgacacaggacaugagacugacgaaaauagagcaaaaguagaaauaacaccgaacagcccuagagcagaagcaacacuuggagguuuuggaucauuaggucuugauugugaaccuagaacagguuuagauuucagcgacuuauauuaucuaacaaugaacaauaaacauugguuagugcacaaagaaugguuucacgacauaccgcugccauggcaugcaggagcagacacaggaacaccucauuggaauaauaaagaagcgcuaguugaauuuaaagaugcacacgcaaaaagacaaacaguaguuguacuaggaagccaagaaggcgcaguucauacagcguuagcaggagcucuagaggcagagauggauggcgcaaaagggagauuaaguaguggacauuugaaauguagacuaaaaauggauaaauuaagauuaaaaggaguaucauauagccuaugcacagcagccuuuacauuuacaaaaauaccagcagaaacauuacauggaacuguaacuguggaaguacaauaugcaggaacagauggcccauguaaaguaccagcacaaauggcugucgacaugcaaacacuaacaccaguuggaagguugauaacugcaaauccagugauuacagaaucaacagaaaauucaaaaaugauguuagaguuagacccaccauuuggagauagcuacauaguaauuggcguaggagaaaaaaaaauuacgcaucauuggcacagaagcggauccacaauaggaaaagcauuugaagcaacaguaagaggagcaaaaaggauggcaguguuaggagauacagcaugggauuuuggaagugucggaggugcucuaaacucauuagguaaagguauacaucaaaucuuuggggcagcauuuaagucgcuauuuggaggaaugagcugguuuagccaaaucuuaauugguacacuacuagucuggcuaggauuaaacacaaaaaaugguucaauaagcuuaaccugucuagcauuagggggcguacuaaucuucuuaucaacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7097 - RNA, 2449 nt, Artificial Sequence
  KX601167.1 prME-short mRNA Design 2 opt
ggggcgcugccuacggagguggcagccaucuccuucucggcaucaagcuuaccaugacaucaguggguaucguaggauuauuacuuacaacagcaauggcaguugaaguaacaaggaggggauccgcauauuauauguacuuagacagaagugacgccggugaagcaauaucauuuccaacaacacuaggaguuaauaaauguuauauacaaauuauggaccuaggacacaugugugaugcaacaauguccuacgaauguccaaugcuagacgaaggaguggaaccagaugauguagauuguugguguaauacaacaaguacauggguaguuuaugggacaugucaucauaagaaaggagaagcacgaagaucaaggagagcugucacauuaccaucacacaguacgagaaaacuacaaacaagaagucaaacauggcuagaaucaagggaauauacuaaacaucuuauaaggguugaaaauuggauauucagaaauccaggauucgcacuagcagcugcagcuauagcguggcuuuuggguaguaguacuagccaaaaagucauauauuugguuaugauucuacuaauugcaccggcauauuccauacguuguauaggaguaucaaauagagacuuuguugaaggaaugucaggaggaaccuggguagauguaguacuagaacacggaggcuguguuacggucauggcacaagauaaaccaacaguagauauagaacugguuacaacaacaguaagcaauauggcugaaguacgaagcuacugcuacgaagcaaguauaucagauauggcaucagacucacgauguccaacacaaggagaagcauauuuagauaaacaaagugauacucaauauguauguaaaagaacucuaguagauagaggaugggggaaugggugcgguuuauucggaaaagguagucuaguuaccugugccaaauuugcaugcucaaagaaaaugacuggaaaaaguauacagccugaaaauuuagaauauagaauaaugcuaucaguacauggaagucaacauuccggaaugauagucaaugauacaggacaugaaacagaugaaaauagagcaaaaguagaaauuacaccaaacaguccaagagcagaagcaacauuaggagguuuugguucauuaggauuagauugcgaacccagaacaggacuagacuuuagugacuuauauuaccuaacaaugaauaauaaacauugguuagugcauaaagaaugguuucaugauauaccauuaccauggcacgcaggagcugauacgggaacaccacacuggaauaauaaagaggcucugguagaauuuaaagaugcacacgcaaaaagacaaacaguaguuguuuuggguagccaagaaggugcaguucacacagcguuggccggagcauuagaggccgaaauggauggugcaaaaggaagacuaucaaguggacaucuaaaauguagacuaaaaauggacaaauuaagauuaaaaggaguaaguuauagccuaugcacagcugcauuuacauucacaaaaauaccagccgaaacauuacauggaacaguaacaguagaaguucaauaugcaggaacagacggaccaugcaaaguaccugcacaaauggcugucgauaugcaaacauuaacuccaguuggaagauugauaacagcaaauccaguaauaacagaaaguaccgaaaacagcaaaaugauguuagaacuugauccaccuuuuggugauaguuauauagugauuggcguaggagauaagaaaauuacacaccauugguauagaucaggaucaacaauaggaaaagcauucgaagcaacuguaagaggagcaaaacgaauggcaguauuaggagacacugcaugggauuuuggaagcguaggaggagcguuaaauucacuaggcaaaggaauacaucaaauauuuggagcagcauuuaaaaguuuguuuggcggaaugagcugguuuagucaaauauuaauaggaacauuauuaguaugguuaggacuaaacacgaaaaauggaucaauaagucuaacauguuuagcucuagguggaguauuaauauuuuuaaguacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7098 - RNA, 2449 nt, Artificial Sequence
  KX694533.2 prME-short mRNA Design 2 opt
ggggcgcugccuacggagguggcagccaucuccuucucggcaucaagcuuaccaugacaucaguuggaauaguuggacuauuacucacuacagcaauggcaguagagguaacacgaagaggcucagcauauuauauguaccuugauaggucagaugccggaaaagcaauuucauuuccaacaacauuagguguaaacaaaugcuauauacaaauaauggaucuaggccauaugugugaugcaacuaugucauaugaaugcccaauguuagaugaaggaguagaaccagaugauguagacuguugguguaauacuacaaguacuuggguaguauauggaacaugucaccauaaaaaaggagaagcaagaagaagcaggagagcagucacauugcccucacauucuacaagaaaauugcaaacgagaagccaaacuugguuggaaucaagagaauacacaaaacacuuaauaagaguagaaaauuggauauuuagaaacccaggauucgcauuggccgcagcagcuauagcaugguuauuaggaucuucuacgucgcaaaagguaauauaucuaguaaugauauuauuaauagcccccgcguauucaauuagauguauuggaguaucaaauagagacuucguagaagggaugucaggaggaacaugggucgauguuguuuuagaacacgguggaugcgucaccguuauggcacaagauaaaccuacagucgauauugaacuaguaacuacuacugucucaaacauggcagaaguucgaaguuauuguuaugaagcaucaauuucagauauggcaucagauaguagauguccaacccaaggagaagcuuauuuagacaaacaaagcgacacacaauauguuuguaaaagaacauuaguugauaggggcuggggaaaugguuguggauuauucggaaaaggaaguuuaguuacaugugcaaaauucgcuuguucuaaaaaaaugacgggaaaaaguauccaaccugagaauuuagaauauagaauaaugcuaucaguacacggaagucaacacagcgggaugauaguaaaugacauaggacaugaaacggaugaaaauagggcuaaaguagaaauaacaccgaacucaccaagagccgaagcaacacuuggugguuucggaucauuaggacuggauugcgaaccaagaacuggauuagacuucagcgaucuauauuacuuaacaaugaauaauaaacacugguuaguacauaaagaaugguuccaugauauaccauuacccuggcaugcaggagcagauacgggaacaccacauuggaauaacaaagaagcccuaguagaauucaaagaugcacaugccaaaagacaaacaguaguaguucuagggagucaagaaggagcaguacauacugcacuagcaggagcauuggaagcagagauggauggagcaaaaggaagauuaucaaguggucauuuaaaaugcagauugaaaauggauaaauuacgauuaaaaggaguaucauacucucuuugcacagcagcauuuacuuucacuaaaauuccagcugaaacucuucauggaacaguaacaguagaaguccaguacgcgggaacagauggaccaugcaaaguaccugcacaaauggcaguagacaugcaaacauuaaccccaguaggaagauuaauaacagcaaacccuguaauaacagaaaguacugaaaacucuaaaaugauguuagaauuagauccaccuuuuggagauucauauauagucauaggaguuggagauaaaaaaauaacacaccacuggcauaggucaggaagcacaauuggaaaagcauuugaagcuaccguaagaggcgcaaaaagaauggcaguauuaggagacacagcaugggauuucgguucuguaggaggugcguuaaacucauuggguaaagggauacaccaaaucuuuggagccgccuuuaagagccuauuuggaggaaugaguugguuuagucaaauacuaauaggaacacuauuaguaugguugggacuaaauacaaaaaauggaagcauaucacuuacauguuuagcauuaggagguguauuaauauuucugucaacugcaguuagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7099 - RNA, 2449 nt, Artificial Sequence
  KY288905.1 prME-short mRNA Design 2 opt
ggggcgcugccuacggagguggcagccaucuccuucucggcaucaagcuuaccaugacaaguauaggaauuguaggucuacuucucacuacagcaauggcagcugagauaacaagacgggguagugcauacuauauguaccuagacagaagugacgcagguaaagcaauuucauuugcaacuacauuaggcguaaacaaaugucauguacaaauaauggauuuaggacauaugugcgacgcaacaaugucauaugaaugcccuaugcuggaugagggaguugaaccugacgauguagauuguugguguaauacaacaucaacauggguagucuacggaacaugccaucauaagaaaggagaagcaagaagaaguaggagagcagugacacuaccuucucauaguacaagaaaauuacaaacuagaagucaaacauggcuagaaucaagagaauauacaaaacauuuaauaaaaguugaaaauuggauauuuagaaauccaggauuuacauuaguagcuguugcaauagcauggcuauugggaucaaguaccagucaaaaaguuauuuaucuaguaaugaucuuauuaauagccccugcauauagcauacgauguauaggaguuucaaacagagauuuuguagaaggaaugaguggagguaccuggguagauguaguauuagaacauggaggcugcguaacggugauggcucaagauaagccaacaguugauauagaauuaguaacaacaacaguaagcaacauggcagaaguuagaagcuacuguuacgaagcaaguauaagugauauggcaucagauaguagaugcccaacgcaaggagaagccuacuuagauaaacaaagugauacacaauauguaugcaaaagaacauuaguugaucgaggauggggaaacgguugcgguuuauuuggaaaaggaucuuuaguaacuugugcaaaguuuacauguaguaagaaaaugacugguaaaagcauacaaccagaaaaucuagaauauagaauaauguuaucaguacauggaagccaacacagcggaaugauaguuaaugacaccggacacgaaacagacgaaaauagagccaaaguagaaguuacaccaaacaguccucgagcggaagcaacacuaggcggauucggaaguuuaggauuagacugugaaccuagaacaggccuagauuuuagugacuuauacuacuuaacaaugaauaacaaacauugguuaguacacaaagaaugguuccaugacaucccacuaccauggcacgcuggugcagauacuggaacaccacauuggaauaauaaagaagcauuaguagaauuuaaagaugcacaugcuaaaagacaaacaguuguuguuuuaggaucucaagaaggagcaguacauacagcacuagcuggcgcucuggaggcugaaauggauggagcgaaaggaagauuauucucaggacacuuaaaauguagauuaaaaauggauaaauugagacuaaagggaguaaguuauagucuauguacagcagcauuuacguuuacaaaagugccugcagaaacacuacauggaacugucacgguagaaguucaauaugcaggaacugauggaccguguaaaguaccagcacaaauggcaguagauaugcaaacauuaaccccuguaggaagacugauaacagcaaacccgguaauaacagaaaguacagaaaacaguaaaaugauguuagaauuggacccgccauucggagauagcuauauaguaauuggcguaggagauaagaaaauaacucaccauuggcacagaaguggaucaacaauaggaaaagcauucgaagcaacaguaagaggagcaaaacgaauggcaguauugggagauacagcaugggauuuuggaucaguaggaggcguauuuaacucgcuaggaaaagggauacaucaaaucuuuggagcagccuucaaaaguuuauuuggaggaaugagcugguuuagucaaauacuuauaggaacacuauuaguaugguuaggauuaaacacuaaaaacggaaguaucucuuuaacauguuuagcauuaggaggagugaugauauucuuaucgacagcugugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7100 - RNA, 2449 nt, Artificial Sequence
  KF268950.1 prME-short mRNA Design 2 opt
ggggcgcugccuacggagguggcagccaucuccuucucggcaucaagcuuaccaugacaaguauaggaauaauaggucucuuguuaacgacagcuauggcagcagaaauaacaagacgagggagugcauauuauauguaccuagaccguucugacgccggaaaagcuauaucauuugccacaaaccucggaguaaacaagugucauguacaaauaauggaucucggucauaugugugacgcgacuaugaguuaugaauguccaaugcuagaugaaggaguagaaccagacgacguugauugcugguguaauacaacaagcacuuggguaguauauggaacaugucaucacaagaaaggggaggccagaagaucaagacgagcaguaacauuaccaucccacagcacaagaaaauuacaaacaagaagucaaacaugguuagaaaguagagaauauacuaaacauuuaauaaaaguugaaaauuggauuuucagaaauccaggauucgcauuagcagcaguagcaauagccuggcuauuaggaucaucaacuucacaaaaaguaauuuaucuggucaugauauuacuaauagcaccagcauauagcauaagaugcauaggaguaaguaacagagauuuuguagaaggaaugaguggaggaacauggguugaugucguauuagaacauggagguuguguaacuguuauggcgcaagauaaaccaacaguagacaucgaauuaguuacaacaacaguaagcaauauggcugaaguaaggaguuauuguuaugaagcauccauuucggauauggccucagauaguagaugcccuacacaaggagaagcauauuuagauaaacaaucagacacacaauaugucugcaaacgaacucuagucgauagaggaugggguaauggcuguggccuauucgguaaaggaucccuaguaacaugcgcaaaauucacaugcucuaagaaaaugacagggaaaucaauccaaccugaaaauuuggaauaucgaauaauguuaaguguacacgggagucaacacucaggaaugauaguaaaugauauagggcaugaaacagaugaaaacagagcaaaaguagaaguaacgccuaauucaccaagagcugaagcaacacuagguggauuugggaguuuaggauuagacugugaaccaagaacaggauuagauuucucagaccucuacuacuuaacaaugaauaauaaacacuggcuaguacauaaagaaugguuccaugauauuccuuuaccauggcacgcaggagcagauacaggcacaccucauuggaacaauaaagaagcucuaguagaauuuaaagaugcacaugcaaaaagacaaacugugguuguauuagguucacaagaaggagcaguacauacagcacuagcuggcgcauuggaagcagaaauggacggagcaaaagguaggcucuuuaguggacaucuaaaauguagguuaaaaauggacaaacuuagguuaaaaggaguaucauacucacuaugcacugcugcuuucacauucacaaaaguacccgcagaaacauuacacggaacagugacaguugaaguacaauaugcuggaacugauggucccuguaagguaccagcacaaauggccguagauaugcaaacauuaacuccaguagguagacuaauaaccgcaaauccaguaauuacagaauccacagaaaauaguaagaugaugcuagagcuagauccaccauuuggagauaguuauauagucauaggaguaggugacaagaaaaucacacaucacuggcauagaaguggcagcacaauuggaaaagcauuugaagcaacaguaagaggagcaaaaagaauggcaguauuaggugauacagcaugggauuuuggaaguguagguggaguuuuuaauucacuaggaaaaggaguacaucaaauauuuggagccgcuuucaaaucacuauuuggaggaaugaguugguuuucucaaauauuaauaggaacauuauuaguaugguuaggucuaaacacuaaaaauggaucaaucucauuaacauguuuagcacucggaggaguuaugauuuuccuaagcacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7101 - RNA, 2449 nt, Artificial Sequence
  KF383121.1 prME-short mRNA Design 2 opt
ggggcgcugccuacggagguggcagccaucuccuucucggcaucaagcuuaccaugacuucaauagguauaauaggucuauuacuaacaacagcaauggcugcagaaauaacacgaagaggaucagcuuacuacauguaucuagacagaagugaugcuggaaaagcaauuagcuucgcaacaacacucggaguuaauaaaugccacguucaaauaauggacuuaggacauaugugugaugcaacuaugaguuacgaauguccaaugcuugacgaagguguugaaccagaugauguagacuguugguguaauacgacuagcacguggguaguauacggaacaugucaucauaaaaaaggcgaagcuagaagaagucgacgagcaguuacacuaccgagucacaguacaagaaaacuacaaacacgaucacaaacaugguuagaaaguagagaauauacaaaacaccuaauaaagguugagaauuggaucuucagaaauccgggguucgcucuuguagcaguagccauagcaugguuauuaggaucuagcacaucacaaaaaguaaucuaucuaguuaugauacuuuugauagcaccagcuuauaguauaagauguauuggaguaucaaauagagacuucguagaaggaaugucuggaggaaccuggguagauguaguauuagaacacggcggaugcguuacaguaauggcccaagauaaaccaacaguagacauagaauuaguaaccacgacaguaaguaauauggcggaagugagaaguuauugcuaugaagcaaguauaucagauauggcaucagauucacgaugcccaacacaaggagaagccuauuuagauaaacaaagcgauacacaauacguuugcaaaagaacucuaguagacagaggauggggaaauggauguggauuauucggaaaaggaucuuuaguaaccugugcaaaauuuacaugcaguaaaaaaaugacagguaaaaguauacaaccagaaaauuuagaauauagaaucaugcuuucaguacacggaucacaacauagcgguaugauaguaaacgacauaggacaugaaaccgaugaaaauagggcaaaaguagagguaacaccaaacucaccaagagcagaagcuacuuuaggaggauuuggaucauuaggguuggauugugaaccacgaaccggacuagauuuuagugaucuauacuaucuaacaaugaauaacaaacauugguugguacauaaagaaugguuucacgacauuccucuaccauggcaugcuggugcagauacuggaacaccacauuggaauaauaaagaagcacuaguagaguuuaaagaugcccaugccaaacgacaaacaguaguaguacuaggaagucaagaaggagcaguacauacagcauuagcuggagcauuagaagcggaaauggauggagcaaaaggaagacuauucaguggucaccuaaaauguagauuaaaaauggauaaauuaagauuaaaaggagugucauauucccuaugcacagcggcauucacauuuacgaaaguuccagcagaaacacuccauggaacagugacaguagagguacaauacgcuggaacugaugguccaugcaaaguaccggcacaaauggcgguugauaugcagacauuaacaccaguagggagguuaauaacagcaaauccaguaauuacagaaagcacagaaaacucuaaaaugaugcuagaguuagauccacccuuuggagacaguuacaucguaauaggaguaggagauaaaaaaauaacgcaucauuggcauagaucagguucuacuauuggcaaagcuuuugaggcaacaguaagaggagcaaaaaggauggcagucuuaggugauacggcaugggauuuuggcucuguaggaggaguuuuuaacaguuuagguaaaggaauucaccaaauauuuggagcggcauuuaaaagcuuauuuggaggaaugaguugguuuucacaaauacuuauagguacguuauuagucuggcuuggauuaaacacaaaaaauggaaguauaucacuaacuugcuuagcauuaggaggcguaaugauauuuuuaaguacugcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7102 - RNA, 2431 nt, Artificial Sequence
  KF268949.1 prME-short mRNA Design 2 opt
ggggcgcugccuacggagguggcagccaucuccuucucggcaucaagcuuaccaugacaagcauuggaauuauaggacuauuauuaacaaccgcaauggccgcagaaauaacgagacguggaagcgcauacuauauguauuuagaccgaucugaugcaggaaaagcuauuucuuuugcgacaaauuuaggaguuaauaaaugccauguucaaauaauggaucuaggacauaugugugaugcaacaaugucauaugaauguccaauguuagaugaaggaguagaaccagacgacguagauuguuggugcaacacaacaucaacauggguaguauacggaacgugucaccauaagaaaggugaagcaagaagaucuaggagagcaguaacauuaccaucgcauagcacaagaaaacuacaaacaagaagucaaaccuggcuagaaucaagagaauacacaaaacaccucauaaaaguggaaaauuggauauucagaaacccaggauucgcuuuagcagcaguagcaauagcauggcuuuuaggaagcaguacaucccaaaaaguaauauauuuaguuaugauauuauuaauagcuccagcauacucaaucaggugcauaggaguaaguaauagggauuucguugaaggaaugucaggaggaacauggguagacguaguauuagagcacggagguugcguaacgguaauggcacaagacaaaccaacaguggauauagaauuaguaacaacaacuguuaguaauauggcggaaguacgaucauauugcuaugaggccucuauaucagacauggcaucagacagcagaugcccaacccaaggagaggcuuacuuagauaaacaaagugacacacaauacguauguaaaagaacacucguugaucgaggcuggggaaauggaugcggauuauuuggaaaaggaucuuuaguuacaugcgcaaaauuuacauguaguaagaaaaugacagggaaaagcauacaaccagaaaauuuagaauauagaauaaugcuaucuguacauggaucacaacauucagggaugauaguaaacgaugaaaaccgagcaaaagucgaaguaacuccaaauucaccucgagcggaagcaacguuaggugguuucgguaguuuagguuuagauugcgaaccuagaacaggacuggauuucagcgauuuauauuaccuaacuaugaacaauaaacauugguuagugcauaaagaaugguuucacgauauaccacucccauggcacgcaggagcugauacaggaacaccacauuggaauaauaaagaagcucuaguagaauuuaaagaugcacacgcaaaaagacaaacaguagugguacuaggaagucaagaaggagccguacauacagccuuagcaggagcauuagaagcugaaauggauggugcaaaaggaagguuauuuucaggacauuuaaaauguagacucaaaauggauaaauuaagauuaaaagguguaaguuauucacuaugcacagcagcuuuuacauuuacaaaaguaccagcagaaacacuacacgggacagugacaguagaaguacaguacgcaggaacagaugggccauguaaaguaccagcacaaauggcuguagacaugcagacauugacaccgguuggaagauuaauaacagcaaauccaguaauaacugaaaguacugaaaauucaaaaaugaugcuagaacuagacccaccauuuggcgacuccuauauaguuauaggagugggugauaagaaaaucacacaucauuggcauagaucaggaaguacgauaggaaaagcguuugaagccacgguuagaggagcuaaaagaauggcagugcuaggagauacggcuugggauuuuggaaguguaggaggcguguuuaauagccuagggaaaggaauacaucaaauauuuggggcagcuuucaaaagucuauuuggagguaugaguugguuuagucaaauauuaauagguacacuauuaguaugguuaggauugaacacuaaaaaugggagcauuaguuugacuuguuuagcacuaggugguguaaugauauuuuuaucaacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7103 - RNA, 2449 nt, Artificial Sequence
  KU955595.1 prME-short mRNA Design 2 opt
ggggcgcugccuacggagguggcagccaucuccuucucggcaucaagcuuaccaugaccucaauugguauugucggacuacuccuaacaacagcaauggcagcagaaaucacucgaaggggaucggcguacuauauguaucuugauaggagcgacgcaggaaaagcaaucucguuugcuacaacauuaggaguaaacaaaugccauguacaaauaauggauuugggacauaugugcgaugcaacaauguccuaugaguguccuauguuggacgaaggaguugaacccgacgacguagacuguugguguaauacgacaagcacauggguuguauaugguacaugucaucauaaaaaaggugaagcuagaagaucucggcgagcagugacauuaccaucacauucaacaaggaaacuacaaacuagaucacaaacaugguuagaaucacgagaauauacgaaacaucuaaucaaaguagaaaacuggauuuuucguaacccaggauuugcccuuguagcaguagcaauagcauggcuucuaggaucgaguacaucccaaaaaguaauuuauuuaguaaugauacuauuaauagcaccagcauauagcauaagauguauaggaguuaguaacagagacuucgucgaaggaaugucaggcggaacauggguugauguaguccuagaacacggcggauguguaacaguaauggcucaagauaaaccaacaguagauauagaacucgucacgacaacaguaucaaauauggccgaaguaagaaguuauuguuaugaagcgaguauuagugacauggccucagauucaagauguccaacccagggcgaagcauaucuugauaaacaaucugacacacaauauguaugcaaaagaacacuuguagacagaggauggggaaauggaugcggacuauuuggaaaaggaagccuaguaacaugugcaaaauucacuuguucaaaaaagaugacaggaaaaagcauucaaccugaaaacuuagaauaucgaauaauguuaucuguucauggaucacaacauucuggaaugauaguaaaugacacuggacaugaaacugacgaaaacagagcaaaaguagaagucacacccaauucaccaagagcagaagcuacacuaggaggauuugguagucuaggucuagauugugaaccaagaacuggacuagauuucucagacuuauacuaucugacaaugaauaacaaacacugguuaguacauaaggaaugguuucaugacauaccucucccuuggcacgcaggagcagauacagguaccccacauuggaacaauaaagaagcacuaguagaauuuaaagacgcccaugcaaaaagacaaacaguaguagucuuaggaagccaagaaggagcaguacauacagcauuagcaggagcucuagaagccgaaauggacggagcaaaagguagacuauuuucuggucaucuaaaaugccgacuaaaaauggacaaauuaagacuaaaagguguaucauacagcuuaugcacagccgcauuuacauucacuaaagucccagcagaaacauuacacgggacaguaacaguagaaguacaauaugcaggaacagacggaccaugcaaagucccagcacaaauggcaguagacaugcaaacauuaacuccaguaggaagacuaauaacagcuaacccaguuauuacagaaucgacagaaaauucaaaaaugaugcuagaacuugauccaccauuuggugauucauauauaguuauaggaguaggagauaaaaaaauaacacaucauuggcauagaucaggaucaacaauaggaaaagcauuugaagcaacaguaaggggcgccaaaagaauggcaguauuaggagacacagcaugggauuuugguucuguuggagguguauucaauucauuaggaaaaggaauccaccaaauauuuggagccgcauuuaaaucucuauuuggaggaaugucaugguucucacaaauauuaauaggaacauuguuaguauggcuaggauuaaacacgaaaaaugggucaauuagucuaaccugucuagcauugggaggaguaaugauauuucuaucaacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7104 - RNA, 2449 nt, Artificial Sequence
  KF383116.1 prME-short mRNA Design 2 opt
ggggcgcugccuacggagguggcagccaucuccuucucggcaucaagcuuaccaugacaucuaucgguauaguaggauuacuauuaacaacggcaauggccgcagagauaacucgaagaggaucagcguacuauauguacuuagauaggucugacgccggaaaagcaauaaguuuugcuacuacauuaggaguaaauaaaugucacguacaaauaauggaucuaggacauaugugugacgcuacuaugucauaugaaugcccaauguuagaugaaggcguugaaccggaugauguagauuguuggugcaauacuacaucaacauggguaguauauggaacaugucaacauaagaaaggugaagcccgaagaagucggagagcugucacauuaccaucacacucaacaagaaaauuacaaacaagaucacaaacaugguuagaauccagagaauacacaaaacaucuaauaaaaguugagaacuggauuuuuagaaacccaggcuuugcuuuaguagcaguggcaauagcgugguuauugggaaguaguacaagucaaaaagugauauauuuaguaaugauucuauuaauagcuccagcauauaguaucagauguauagguguaucaaauagagauuuuguagaaggaaugagcggaggaaccuggguagaugucguauuagaacauggaggauguguaacuguuauggcacaagacaaaccuaccguagauauagaauuaguaacaacuacuguuaguaauauggcugaagucagaagcuauugcuacgaagcaaguauaagugauauggcaagugauucgagauguccaacucaaggcgaagcauaucuugauaaacaaagcgauacacaauauguauguaaaaggacguugguagauagagguuggggaaacggauguggcuuauucggaaaaggaagucuaguuacuugcgcgaaauuuacauguagcaagaaaaugacagguaaaaguauacaacccgaaaaucuagaauauagaaucauguuaucaguacacggaucacaacauaguggaaugauaguaaaugauauaggacacgaaaccgaugaaaauagagccaaaguugaaguaacgccaaauucgccaagagcugaagcaacauuaggaggauucggaucucuuggauuagauugcgagccaagaacaggauuagacuuuagugauuuauacuaucuaacuaugaauaacaaacauugguuaguacauaaagaaugguuucaugauaucccauuaccuuggcaugcaggagcagauacagggacaccucauuggaauaauaaagaagcauuagucgaguucaaagacgcucaugcaaaaagacaaaccguaguaguacuaggaucacaagaaggagccguacauacggcgcuugcaggagcauuagaagcagaaauggauggagcaaaaggaagauuauuuucuggacauuuaaaauguagauuaaaaauggauaaacugagauuaaaaggaguuucuuauucuuuauguacagcaguuuguacagcagcuaaagucccagcagaaacacuacauggaacaguaacaguagaaguacaauaugcaggaaccgaugguccauguaaaguaccagcucaaauggcagucgauaugcaaacauuaacuccgguaggaagacuaauuacagcuaacccaguaauaacagagucaaccgaaaauagcaaaaugauguuagaauuagauccaccauuuggagauagcuacauuguaauaggaguuggagauaagaaaauaacacaucauuggcauagaucgggaagcaccauugggaaagcauucgaagcgacagugaggggagcaaaaagaauggcaguauuaggagauacagcgugggauuuuggaucuguaggaggaguauuuaauaguuugggaaaaggaauacaucaaauauuuggagcagcauuuaaaucauuauuuggaggaaugagcugguuuucacaaauauuaauaggcacacuauuggucuggcucggacugaauacuaaaaacggaaguauuaguuuaacgugccuagcauuaggaggcguaaugauauuccuuaguacagcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7105 - RNA, 2431 nt, Artificial Sequence
  KX601166.1 prME-short mRNA Design 2 opt
ggggcgcugccuacggagguggcagccaucuccuucucggcaucaagcuuaccaugaccucaauaggaauaguaggcuuguuguuaacaacagcaauggcagccgaaauuacaagaagagguuccgcauauuauauguaccuagauagaucagaugcagggaaagcaauaaguuuugcaacaacuuuaggagucaauaaaugucauguacaaauaauggauuugggacauaugugugaugcaacaaugagcuacgaauguccaauguuagaugaaggaguugaaccugacgauguagauuguugguguaauacaacaaguacauggguaguauacggaaccugucaucauaaaaaaggagaagcucgaagaagcagaagggcuguaacacuaccgucucauagcacuagaaaauuacaaacacgaucccaaacauggcuagaaaguagagaauacacaaaacauuuaauaaaaguagaaaauuggauauuuagaaaucccggauucgcuuuaguagccguagcaauugcaugguuauuaggaucaucuacaucacaaaaaguaauauaucuuguaaugauacuauuaauagcgccggcauauaguauuagaugcauaggaguaaguaauagagauuuuguagaaggaaugaguggugguacguggguagaugucguucuagaacacggaggaugcguaacaguaauggcacaagacaaaccgaccguagacauagaauuaguuacaacuaccguuucaaacauggccgaagugagaucuuacuguuaugaagcuucaauaagugauauggcaucagauucaagaugcccuacacaaggagaagcguaccuugacaaacaaucggauacacaauauguaugcaaaagaacacuaguagaucgaggauggggaaacgguuguggacuguuuggaaaaggaaguuugguaacuugugcaaaauuuacauguucaaaaaaaaugacagguaagucaauacaaccagaaaaccuugaguauagaauaaugcuaucaguacauggaagucagcacucaggaaugauaguaaaugacgaaaacagagccaaaguagaaguuacucccaauaguccacgagcggaagcaacauugggaggguuuggaucucuaggucuagauugcgaaccgagaaccggauuagauuucagugauuuauauuauuuaacaaugaauaauaaacacugguuaguucacaaagaaugguuccacgauaucccauuaccauggcaugcuggagcggauacgggcacaccacauuggaauaacaaagaagcacuaguugaauuuaaagaugcacaugcaaaacgucaaacaguaguaguauuaggaucccaagaaggcgcuguacauacagcacuagcaggugcauuagaagcugaaauggauggugcuaaaggacgcuuauuuucaggacaucuaaaaugucgucuaaaaauggacaaauuaagacuuaaaggaguaaguuauagcuuauguacugcagcauuuacuuuuacaaaaguaccagcugaaacauuacacggaacagugacaguugaaguacaauaugcugggacagacggaccauguaaaguaccagcccaaauggcaguagauaugcaaacauuaacgccuguaggucguuuaauaacugcuaacccugucauaacggaaucaacagaaaauucaaaaaugauguuagaauuagauccaccuuucggagacucauacauaguaauaggaguuggagacaagaaaauaacucaccacuggcauagaucaggaaguacgauugguaaagcauuugaagcaacggugagaggagcaaaaagaauggcaguauuaggggauacagcgugggauuuuggaaguguaggaggaguuuuuaacucauuaggaaaagguauacaccaaauauuuggugcagcauuuaaaucucuauuuggagguaugucaugguuuucacaaauauuaauagguacacuauuaguaugguugggacuaaauacaaaaaauggaucaauaucucuaacaugcuuagcuuuaggaggaguaaugauauuuuuaaguacagcagugucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7106 - RNA, 2449 nt, Artificial Sequence
  KF383118.1 prME-short mRNA Design 2 opt
ggggcgcugccuacggagguggcagccaucuccuucucggcaucaagcuuaccaugacuucaauaggaauaaucggguuacuauuaacaaccgcaauggcagcugaaauaacccgaagaggaucagcauacuauauguaccuagauagaucagacgcaggaaaagcaauaagcuuugcaacgacgcucggaguaaacaaaugucauguccaaauaauggauuugggacacaugugugacgcaacuaugucauacgaauguccaaugcuugaugaaggaguagaaccagaugauguagauuguugguguaacacaacuucaacauggguaguauacggaacuugucaucauaagaaaggagaaaccagacgaagccgaaggucaguuagucuaagauaucacuacacaagaaaacuacaaaccagaucacaaacauggcuagaaucaagagaauauaaaaaacacuuaauuaugguagagaauuggauauuucguaauccagguuuugcaauagugaguguagcaauuacuuggcuuaugggaaguuuaacuagucaaaaaguuauauauuuaguaaugauaguacuaaucguaccagcauacagcauaucaugcauaggaguuaguaacagagaucuaguugaaggaaugucaggaggaacuuggguagacguuguauuagaacacggaggauguguaacagaaauggcgcaagacaaaccgacagucgauauagaauugguaacaaugacaguaagcaauauggcagaaguaagaucauauuguuaugaagcaucacuaucugacauggcaucggcaucacgaugcccaacacaaggugaaccaaguuuagauaaacaaagugauacacaaagcguuuguaaaagaacauuaggugauagagguuggggaaacgguuguggaauauuuggaaaaggaucacucguaacauguucuaaauuuaccuguuguaaaaaaaugccaggaaaauccauucaacccgaaaauuuggaauauagaauaaugcugcccguacauggaagucaacauaguggaaugauaguaaaugauauaggacaugaaacagaugaaaaucgugcaaaaguugaaguaacaccaaauucaccuagagcagaagcaacguuaggaggauuuggaagucuaggcuuagauugugaaccaagaacaggauuagauuuuuccgauuuauauuaucuaacaaugaauaacaaacacugguuaguacauaaagaaugguuucaugauauaccauuaccauggcaugcgggagcugacacuggaacaccacauuggaacaauaaggaagcgcuuguagaauucaaagaugcacacgcaaaaagacaaacaguaguaguacuaggaucacaagaaggagcaguacauacagcauuagccggagcacuagaagcagaaauggacggagcaaaagguagacuauucaguggucauuuaaaaugcagguuaaaaauggauaaacuccguuuaaaaggaguuucuuauaguuuauguacagcagcauuuacauuuacuaaaguaccugcagaaacauuacauggaacaguaacuguagaaguacaaucagccggaacagauggaccuugcaaaguaccugcacaaauggcaguagauaugcaaacacuaacaccgguaggaagacuaauaacagcaaaccccguaauaacugaaucaacagaaaacucuaaaaugaugcuagaacuagauccuccuuuuggugacucauauaucgugauaggcguaggagauaaaaaaaucacacaucacuggcacagaucaggaucuaccauaggaaaagccuucgaagcaacaguaagaggagcaaaaaggauggcaguguuaggcgauacagcuugggauuuuggcagcguaggcggaguauuuaacucacuuggaaaaggaauacaucaaauauuuggcgcagcauucaaaucccuauuuggaggaaugaguugguuuucacaaauauuaauagguacauuacuuguaugguuagguuuaaauacaaaaaacggcucaaucaguuuaacuugccuagcuuuaggaggaguaaugauauuucuaagcacagcagugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7107 - RNA, 2446 nt, Artificial Sequence
  KX447520.1 prME-short mRNA Design 2 opt
ggggcgcugccuacggagguggcagccaucuccuucucggcaucaagcuuaccaugaguguuggaauaguaggauuauuacuuacaacagcuauggcagcagaggucacaagacgaggaucagcuuacuauauguauuuagacaggaaugaugcuggugaagcaauaucauucccgaccacccuggguaugaacaaauguuacauacaaauuauggaucuuggacacaugugugacgcaacuaugucauaugaauguccaaugcuagaugaaggaguagaaccagacgauguagacugcuggugcaacacaacaagcacuuggguaguauauggcaccugucaucauaaaaaaggagaagcuagaagaaguagaagagcaguaacauuaccaagccauuccacuagaaaauuacaaacaagaucacaaacaugguuagaauccagggaauauacaaagcaccucauaagagucgaaaauuggauauuuagaaacccaggauucgcccuugcagccgcagcaauagccugguuacuuggaucgagcacaagucaaaaaguuaucuaucucguaaugauauuauuaauagcaccagcauauagcauacgauguauuggcguaucgaauagagauuuuguagaaggaaugagcggaggaacauggguagacgucguucuagaacaugguggaugcguaacaguaauggcacaagauaaaccuacaguugauauagaauuaguaacaacaacaguaaguaauauggcagaaguaaggagcuauugcuacgaagcaucaaucagugauauggcauccgauucaagauguccaacacaaggagaagcauacuuagauaaacaaucagauacacaauauguauguaaacguacacuuguagacagaggauggggaaacggauguggucuauucggaaaggguagccuaguaacaugcgcaaaauucgcaugcaguaaaaaaaugacugguaaaagcauacaaccagaaaaucuugaauauagaauaauguuaucaguacauggaagucaacauucugggaugauaguuaaugauaccggacaugaaacugaugaaaacagagcaaaaguugaaauuacuccaaauucaccaagagcagaagcaacauuagguggcuuuggaaguuugggacuugauugcgaaccuagaacaggacuagacuuuagugauuuguauuacuuaaccaugaacaauaaacauugguuaguacauaaagaaugguuccaugacauuccauuacccuggcaugcuggagcggauaccgggacaccacauuggaacaacaaagaagcauuaguagaauuuaaagacgcacacgccaaaagacaaacuguaguaguacugggaagccaagaaggagcaguacauacagcgcuagcaggagcauuagaagcagaaauggauggugcaaaaggaagauuaagcucaggucauuuaaaaugcagacuaaaaauggacaaacuuagauuaaaagguguaaguuauucacuauguacugcagcuuucacauuuacuaaaauaccagcagaaacacuacauggcacaguuacuguagaaguccaauacgcaggaacagauggaccuuguaaaguucccgcacagauggccguagauaugcaaacacuuacuccaguaggccgacuuauaacagcaaacccuguaauaacagaaucaacagaaaauuccaaaaugauguuggaauuagaccccccguuuggugauaguuacauaguaauaggagucggggaaaaaaaaauaacccaucacuggcaucgauccggcagcacaauaggaaaagcauuugaagccacuguaagaggagcaaaaagaauggcgguauuaggagauacagcaugggauuuuggaagcguagguggcgcacuaaauuccuuaggaaaagguauacaucaaauauuuggagcugcauuuaaaucucuuuuugggggaaugucaugguuuagucaaauuuuaauaggaacucuauuaaugugguuaggucucaauacaaaaaacggaucaauaaguuuaauguguuuagcuuugggaggaguccuaauauuuuuaagcacggcuguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7108 - RNA, 2449 nt, Artificial Sequence
  KU761561.1 prME-short mRNA Design 2 opt
ggggcgcugccuacggagguggcagccaucuccuucucggcaucaagcuuaccaugacaucaguagguauaguaggacuacuguuaacaacagcaauggcagcagaaguaacuagaagaggaucggcauauuauauguaucuugaccggaaugaugcgggagaagcuauaagcuuuccaacuacuuuaggcaugaauaaauguuauauccaaauaauggaucuaggacauaugugugacgcaacaaugaguuacgaauguccaauguuagacgaagggguagagccugaugacguagauugcuggugcaacacgacaaguacaugggucgucuauggaacaugucaucauaaaaaaggagaagcacgaagaaguaggcgagcaguaacucuucccucacacaguacacgaaaauuacaaacaagaagucaaacaugguuagaaucccgagaguauacaaaacacuugauaagaguagaaaauuggauuuuuagaaauccaggauuugcacuagcagccgcagcaaucgcauggcuacuuggaagcaguacaagucaaaaagucauuuauuuagucaugauauuauuaauugcaccugcauauucaauaagaugcaucggagugucgaauagagauuuuguagaaggaaugaguggaggaacauggguagauguaguauuagaacauggaggcuguguaacugucauggcccaagauaaacccacaguagauauagaauuaguaacgacaacaguaucaaauauggcagaaguaagaucauacuguuaugaggcuaguauuucagacauggcaagugauucuagaugucccacgcaaggugaagcauaucuagacaagcaaucagauacacaauauguauguaaaaggacauuaguggaucgaggcuggggaaaugguuguggacuuuuugggaaagguucauuagucacaugugcaaaauuugcguguucaaaaaaaaugacaggaaaaaguauccaaccagaaaacuuagaauacagaauaaugcuaucuguacacggaucucaacauaguggcaugauaguaaaugauacgggacaugaaacugacgaaaacagagcaaaaguagaaauaacaccaaacucaccuagagccgaagcaacauuaggcggauuuggaucucuaggauuagauugcgaaccaagaacuggauuagauuucucagauuuauauuaucuaacaaugaauaacaaacauugguugguacauaaagaaugguuucacgacaucccauuaccauggcaugcaggagccgauacuggaacaccacauuggaacaauaaagaagcacuuguugaauuuaaagaugcacacgcaaaacgacaaacuguuguaguucuaggaucgcaagaaggugccguacauacagcgcuugcaggagcacucgaagcagaaauggauggcgcaaaaggaagauuaaguucagggcaucuuaaaugcagacuaaaaauggauaaauuaagguuaaaaggaguuucauauaguuuaugcacagcagcauuuacauuuacuaaaauaccagcggaaacauugcacggaacagugaccguagaagugcaauaugccggaacagacggucccuguaaaguaccagcucaaauggcuguagacaugcaaacguuaacuccagucggaagauuaaucacagcgaacccaguaauaacagaaaguacagaaaauucaaaaaugauguuagaauuagacccaccauuuggugauagcuauauaguaauaggaguaggugaaaaaaaaauaacccaucauuggcauaggucuggaaguacaauagguaaagcauucgaagcaacaguaagaggagcuagaagaauggcuguauugggagauacugcgugggacuuuggaucaguagggggagcccuuaauucacuaggaaaaggaauacaucaaauuuuuggagcagcauucaaaucacuauuuggagguaugucaugguuuagccaaauucuaauaggaacauuauuaauguggcuuggauuaaacacaaaaaauggaaguauuucacuaaugugccuagcacucgguggaguguuaaucuuuuuaucaacagcaguaucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7109 - RNA, 2449 nt, Artificial Sequence
  KX806557.2 prME-short mRNA Design 2 opt
ggggcgcugccuacggagguggcagccaucuccuucucggcaucaagcuuaccaugacuucaguagguauaguaggauuacuuuuaacuaccgcgauggcagcagaaguaacaagaagagggucagcuuauuacauguacuuagacagaaaugaugcaggagaagcaaucaguuucccaacuacauuagguaugaacaaauguuacauccaaauuauggauuuaggacauaugugugacgcaacaauguccuacgaauguccaauguuagaugaaggaguugaacccgaugacgucgacuguuggugcaauacaacaaguacuuggguagucuaugggacaugccaucauaagaaaggagaagcgagaagaagucgacgagcaguaacacuaccaucucauaguacaagaaaauuacaaacacgaagucaaacauggcuagaaucuagagaauauacaaaacaucuaaucagaguagaaaauuggauguuucgaaauccuggauuugcacuagccgcagcagcaauagcauggcuauuaggaucaucaacaucacaaaaaguaauuuacuuaguaaugauuuuguuaauagcuccugcauauaguauaagaugcauaggaguaucaaacagagauuuuguagaaggaaugucaggagguacauggguagauguaguuuuagaacauggcggauguguaacaguuauggcacaagauaaaccaacuguagauauagaauuaguaacaacuacaguaucuaacauggcugaaguuagaucguacuguuacgaagcaagcauuucugacauggcaucagauucuagauguccuacacaaggagaagcauaucuugauaaacagucagauacacaauacguauguaaaagaacauuaguagauaggggauggggaaauggaugcggucuauuugggaaaggaucguuaguuacaugugcaaaauucgcauguaguaagaaaaugacaggcaaaucaauacaacccgagaaccuugaauauagaauaauguuaagcguucauggaucccaacacagcggaaugauagucaacgauaccggucacgaaacugaugaaaaccgugcaaaaguagagauaacuccaaacucaccacgugcagaagcaacauuaggagguuuuggcucucuaggacucgacugugaacccagaacuggucuagacuuuucagaucuauauuauuugacaaugaauaacaaacauuggcugguucauaaagaaugguuccaugauauaccauuaccauggcaugccggagcagauacaggaacuccgcacuggaacaauaaagaggcuuuaguagaauuuaaagaugcccaugcaaaacgacaaacaguaguuguauuaggaagucaagaaggugcaguucacacagcucuggcaggagcauuagaggcagaaauggacggcgcuaaagguagauuaucauccggacauuuaaaauguagauuaaaaauggauaaauuaagauuaaaagguguaagcuauagccuaugcacugcugcauuuacauucacaaaaauaccagcagaaacauuacauggaacaguuacgguugaaguucaauaugcagguacugacggaccauguaagguaccugcacaaauggcaguggauaugcaaacauugacucccguugguagguuaauaacagcaaauccagucauaacugaaucaacagaaaauucaaaaaugaugcuagaauuagauccuccauuuggagacaguuacauaguaauaggaguaggugaaaagaaaauaacacaucauuggcacagaagcggaaguacuaucggaaaagccuuugaagccacgguuagaggugcaaaaagaauggcgguauugggagauacagcaugggacuucggcaguguaggaggagcuuuaaauucauuaggaaaaggaauacaccaaauauucggagcugcauuuaaaagccucuucggagguaugucaugguuuucccaaauucuaauaggaacacuacuaaugugguuaggacuaaauacuaaaaauggaucaauaucacuaaugugcuuagcacucggaggaguacuaaucuuccuaucaacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7110 - RNA, 2449 nt, Artificial Sequence
  LC191864.1 prME-short mRNA Design 2 opt
ggggcgcugccuacggagguggcagccaucuccuucucggcaucaagcuuaccaugacaaguguagguauaguaggacuauuauuaacaacagcuauggcagcagaaguaacgcggagagggucagcguauuauauguaucucgauagaaacgaugccggagaagcaauaagcuuuccaacaacauugggaaugaauaaauguuauauacaaauaauggauuuaggacauaugugugaugcaaccaugucauacgagugcccaauguuagaugaagguguagaaccagaugauguugauuguuggugcaacaugacaaguacauggguagucuauggaacaugucaucacaaaaaaggagaagcaagaagaucaagaagagcaguaacacuacccucccauucaacgagaaaacuucaaacaaggagucaaacaugguuagaaucccgagaauacacaaaacaucuaauaagaguagaaaauuggauauuucgaaauccagguuuugcucuagcugcagcagcgauagcaugguuacuuggaagcucuaccucacaaaaaguaauauauuuaguuaugauucuacuaauagcaccagcauauucaauaagaugcauaggaguaucaaaucgagauuuugucgaaggaaugucaggaggaacauggguagauguuguccuagaacauggaggguguguuacuguaauggcacaagauaaaccuacaguagacauagaacuuguaacaacaacaguaucaaauauggcugaaguucguucauauuguuaugaagcuaguauaagcgacauggccagcgauucaagauguccaacacaaggagaagcauacuuagauaaacaaagugauacacaauauguaugcaaacgaacucuuguugauagaggaugggguaaugguugcggauuauuuggaaaaggaucacuuguaacaugugcaaaauuugcauguaguaagaaaaugacgggcaaaucaauacaacccgaaaauuuggaauauagaauaauguuaaguguucauggaagccaacacucaggaaugauaguaaaugauacaggacaugaaacagaugaaaaucgagcaaaaguagaaauaaccccuaacagcccacgagcagaagcaacguuaggaggauuuggaucacuaggccuagauugugaaccacgaacuggacuugacuuuagcgauuuauacuaccugacuaugaacaacaaacacugguuaguacauaaagaaugguuucaugacauaccacuuccuuggcaugcaggugcagauacaggaacaccacauuggaauaauaaagaagcuuuaguagaauuuaaagaugcgcaugcaaaacgccaaacaguuguaguauuaggcucccaagaaggagcgguacauaccgcccucgcaggagcauuagaagcagaaauggauggagccaaagguagauuaucaucuggccauuuaaaauguagguuaaaaauggacaaauuacgauuaaaagguguaaguuauucauuaugcacagcugcauucacauucacaaaaauuccagcagaaacauuacacggaacaguaacaguugaaguucaauacgcgggaaccgacggaccauguaagguaccagcccaaauggccguagacaugcaaacauuaacaccaguaggaagauuaauaacagcuaauccaguaauaaccgaaagcacagaaaauucaaaaaugauguuagaauuagauccuccauuuggagauucguauaucgugauugggguaggagaaaaaaaaauuacacaccacuggcauagaucaggcucaaccauaggaaaagcauuugaagcuacuguaagaggugcuaaaagaauggcaguucucggugacaccgcaugggacuuuggaaguguagguggugcauuaaauucauuaggaaaaggaauccaccaaauauuuggagcagcauuuaaaucguuauucggaggcaugucaugguuuagucaaauauuaauagguacuuuauuaaugugguuaggacuaaauacaaaaaaugguaguauaaguuuaauguguuuagcucuaggaggaguauugauauucuuaucaacugcaguuagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7111 - RNA, 2449 nt, Artificial Sequence
  KU744693.1 prME-short mRNA Design 2 opt
ggggcgcugccuacggagguggcagccaucuccuucucggcaucaagcuuaccaugaccagcguaggaauaguuggucuauuacuaacaacagcuauggcagcagaaguaacaagaaggggaucagcauauuauauguauuuagaucgaaaugaugcuggagaagccauaucuuuucccacaacacuaggaaugaacaaaugcuauauacaaauuauggauuuaggucauaugugugaugcaacaaugucauacgaauguccuauguuagaugaaggaguagaaccggaugauguagauuguugguguaauacaaccucaacauggguagucuacgguacuugucaucauaaaaaaggugaagcaagaaggaguaggagagcgguaacuuuaccaucgcauucaacaaggaaacuucaaacaagaagucaaacauggcuagaaaguagagaauauacaaaacaucucauaagaguugaaaacuggauauucagaaauccuggcuuugcuuuggcugcagcagcaauagcgugguuacuagggucaucaacaucgcaaaaaguuauauaccugguuaugauauuauuaauagcaccggcauauaguauuagauguauaggaguaucaaauagagauuuuguugaaggaaugagcggcggaacauggguagacguuguucuagaacauggaggaugcguaacagcuauggcucaagauaaaccgacaguagacauagaauuaguaacaacuacaguuagcaauauggcugaagucaggucauacuguuacgaagccagcauaagugauauggcuagcgacaguagaugucccacucaaggagaagcauaucuagauaaacaaagcgauacacaauauguguguaaacguacauuaguagacagaggauggggcaauggaugcggauuauuuggaaaagguagucuaguaacaugugcaaaauuugccugcagcaaaaaaaugacaggaaaaaguauacaaccagaaaacuuagaauaccgaauaauguuaucaguacaugguagucaacacaguggaauguuaguaaacgauacaggucaugaaacagaugaaaaucgugcaaaaguagaaauaacaccaaauucgccaagggcagaagcaacucuaggaggauuuggaucacuagguuuggauugugaaccaaggacaggacuagauuuuucagauuuauauuaucuaacuaugaauaauaaacauugguuagcacauaaagaaugguuucacgauauaccauuaccauggcacgcgggagcagcaacuggcacaccacauuggaauaauaaagaagcauuaguagaauucaaagaugcacacgcaaaaaggcaaacuguaguaguacuaggcucacaagaaggagccguacauaccgccuuagcaggagcauuagaagcugaaauggauggagcaaaaggaagauuaucuucuggacaucuaaaaugucgauuaaaaauggauaaacuaagauugaaaggaguaagcuacuccuuguguacagcugcauuuacauuuacaaagaucccagcugaaacaguugauggaacuguaacuguagaaggacaguauggaggaacagaugggccuuguaaaguuccagcacaaauggccguagauaugcaaacguuaacuccuguuggaagacuaauaacagcaaauccgguaaucacagaaagcacagaaaauagcaaaaugauguuagaauuagacccaccuuuuggagauucauauauaguaauugguguaggagaaaaaaaaauaacacaccacuggcauagaucuggaaguacaauaggaaaagcauuugaagcaaccguaaggggagcgaaaagaauggcaguucuaggcgauacagccugggacuuuggaagcgucggaggcgcauuaaauaguuuaggaaaaggaauacaucaaauuauaggagcugccuucaaaucauuauucggaggcaugucuugguuuagucagauauuaaucgguacauuacuaaugugguuaggauuaaauacaaaaaacgguagcauaucauuaaugugucuagcguuaggaggaguuuuaauuuuucuaaguacagcaguaucagggugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7112 - RNA, 2440 nt, Artificial Sequence
  KU963574.2 prME-short mRNA Design 2 opt
ggggcgcugccuacggagguggcagccaucuccuucucggcaucaagcuuaccaugggggcagacgcuucuauaggaauaguaagccuauuauuaacuacuguuauggcagcagaaauaacaagaagggguagugccuauuauauguauuuagacagaagugaugcaggaaaagcaauaaguuuugucacaacuuuaggaguaaauaaaugucacguucaaauaauggauuuaggacauaugugcgaugcgacaaugaguuaugaauguccuauguuagaugaaggcguagaaccagaugacguagauuguugguguaauaccacaucaacuuggguuguauauggaacuugucaucacaaaaaaggagaagcgagaagaucaaggagagcaguaacauuaccaagucauucaacaagaaaacuucaaacaagaagccaaacaugguuagaaaguagagaguacacuaaacaucuaauaaaaguagaaaauuggauauuuagaaauccagguuuugcacuaguugcagucgcuauagccuggcuacuaggaucaucuacaagccaaaaaguaaucuaucuaguaaugaucuuacuaauagcaccagcauauaguauaagauguauuggaguaagcaauagagauuuuguagaaggaaugagcggaggaacuuggguugacguaguauuagaacauggcgguugcguuacagucauggcacaagauaaaccaacaguagauauugaacuagugacaacaacagugagcaauauggcagaaguaagaucguauuguuaugaagcaucaauaucugauauggcuucugauagcagaugccccacacaaggugaagcauauuuagacaaacaaagugacacacaauauguauguaaaagaacauuaguagacagaggauggggaaacggauguggauuguuuggaaaagguaguuuaguuacaugugcaaaauucacuuguucaaaaaaaaugacaggaaaaucuauccaaccagaaaauuuagaauacagaauuaugcuaaguguucauggaagucaacacucgggaaugauagucaaugacgaaaacagggccaaaguugaaguuacgccaaacucaccuagagcagaagccacacuaggaggauuuggaucacuaggacuugacugugaacccagaacgggacuagauuuuagugauuuauauuaucuuacaaugaauaacaaacauuggcuaguacacaaagaaugguuucaugacauaccacuacccuggcacaguggugcagauaccgaaacaccacauuggaacaauaaagaagcacuaguagaauucaaagaugcacaugcaaagagacagaccgugguuguacuagggagccaggaaggagcaguacacacggcauuagcgggagcauuagaagcagaaauggacggagcgaaaggaagauuaucaagcggacaucuaaaauguagauuaaaaauggauaaauugagauuaaaaggaguuucauacaguuuauguaccgcugcauuuacuuuuacuaaaguucccgcugaaacgcuacacggaacaguaacaguagaaguucaauaugccggaagagacggucccuguaaaguacccgcacaaauggccguagauaugcaaacacuaacaccggugggaagacuaauaaccgccaacccaguuauuacagaaucaacagagaauucaaaaaugauguuagaauuagaucccccauuuggugauucuuauauaguaauaggaguaggugauaaaaaaauaacccaccacuggcauaggagcggaucaauaauaggcaaagcauucgaagcaacaguccgaggagcaaaaagaauggcaguacuuggugauaccgcaugggacuuuggaaguguaggaggaguauuuaauagucuagguaaaggaauucaucaaauuuuuggagcggcuuuuaagucauuauucggaggaauguccugguucagucaaauccuaauaggaaccuugcuaguaugguuaggauuaaauacaaaaaauggcucaauuucauuaacaugucuagcacuuggcggaguaaugauauuuuuauccacugcaguaucggcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7113 - RNA, 2458 nt, Artificial Sequence
  KF383120.1 prME-short mRNA Design 2 opt
ggggcgcugccuacggagguggcagccaucuccuucucggcaucaagcuuaccaugggagccgacacuaguauaggaauaauaggauuauuauuaacuacagcaauggcggcugaaauaacucgaagaggaucagcauauuauauguauuuagauagaucagaugcuggaaaagcaauaaguuuugcaacaacaaugggaguaaacaaaugccauguacagauuauggaucuaggucacaugugugaugcuacaaugaguuaugaaugcccaauguuagaugagggaguagaaccagaugauguggauuguugguguaauacaacgucaacauggguuguauauggaacaugucaccacaaaaaaggagaagcaaggccgucaagacgagcaguaacauuaccuagucauaguaccagaaaacuacaaacuagaagccaaacaugguuagaaaguagagaauauacaaaacacuuaauaaaaguggaaaauuggauacuaaggaauccaggcuuuacuguagcggcauuagcuauggcauggcuacuugggaauucaacaucacaacgaguaauauauuuaguaaugauauuacuaauagcgccugcauauuccauaagaugcauuggaguaagcaaccgcgacuuuguagagggaaugucaggcggaacuuggguugauguaguauuagaacacgguggauguguaacuguaauggcacaagacaaaccuacaguagacauugaauuaguuacgacaacaguaagcaauauggcagaaguacguuccuauuguuaugaagcuaguauaucagauauggcaagcgauucuagauguccuacacagggagaagcauauuuagacaaacaaagugauacacaauacguaugcaaacgcacccuaguagaucgaggauggggaaacgggugcggauuauuugguaaaggaucauugguuacuugcgcgaaauuuacauguaguaaaaaaaugacaggaaaaucaauucaaccugaaaauuuagaauaucgaauaaugcugucaguacauggaucacaacauaguggcaugauagucaaugauauaggacaugaaacagaugaaaacagggccaaaguagaagucacccccaauucccccagagcagaagcgacauuaggcggcuuuggaaguuuaggauuagauugcgaacccagaacaggauuagauuuuucugauuuauauuaucuaacaaugaacaacaaacacugguuaguacacaaagaaugguuucacgacauaccccuaccguggcaugcaggagcagauaccggaacaccacauuggaauaauaaagaagcauuaguagaauuuaaagaugcucacgcaaaaagacaaacaguuguaguauuaggaucucaagaaggugcuguacauacagcacuugcaggagcauuagaagcagaaauggauggagcaaaaggaagauuauuuuccggacaccuuaaaugcagaauaaaaauggacaagcuaagauuaaagggaguaaguuauucacuauguacugcagcuuuuacauuuaguaaaguaccagcagaaacuuuacaugguaccguaacuguugaaguucaauaugcaggaagggaugggccaugcaaaguaccugcccaaauggcaguagauaugcaaacuuuaacgccuguagguagauuaauuaccgcaaauccuauuauuacagaaucaacugaaaauagccgcaugauguuagaacuagauccgccauuuggugauagcuauauaguuauaggaguaggagauaaaaaaauaacacaucauuggcauagaaguggaucaaccauaggcaaagcauuugaagcaacaguaagaggagcgaaaagaauggcaguacuaggcgauacugcaugggacuuuggaucaguagguggaguauucaauucauuaggaaaaggaguacaucaagucuuuggagcugcuuucaaaaguuuauuuggagggaugucaugguuuagccaaauauuaauugggacuuuauuaguuuggcugggauuaaauacaaaaaauggaaguauaucauuagcuugucuugcacuaggaggagcaaugauauuccuaagcacagcuguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7114 - RNA, 1741 nt, Artificial Sequence
  KU321639.1 solE mRNA Design 2 opt
ggggcgcugccuacggagguggcagccaucuccuucucggcaucaagcuuaccaugucacaaaaaguaauauauuuaguaaugauacuauuaauagcaccagcuuauagcauaagauguauaggaguuucaaacagggauuucgucgaaggaaugagugguggaacauggguagauauaguucuagaacauggagguuguguaacagugauggcacaagauaaaccaacuguagauauagaauuaguuacuacaaccguaucaaauauggcagaaguuagaucauauuguuaugaagcaucaauaagugauauggccucagauucaagauguccaacacagggggaagccuacuuagauaaacaaucagauacucaauauguauguaaaagaacauuaguagauagagguuggggaaauggauguggauuauuuggaaaagguaguuuaguaacgugugcaaaauucgcauguucuaaaaaaaugacaggaaaaaguauacaaccugaaaaccuagaauauagaauaaugcuaucaguacaugguagucaacauucgggaaugauaguaaaugauacaggacaugaaacagacgaaaauagagcaaaaguugaaauaaccccaaauaguccaagagcagaagcaacauuaggaggauuuggaucauuaggacuagauugcgaaccaagaacaggauuagauuuuagugauuuauauuaucuaacaaugaauaauaaacacugguuaguacauaaagaaugguuccaugauauaccacuaccauggcacgcaggugcagauacaggaacaccacauuggaauaauaaagaagcauuaguugaauucaaagacgcccaugcaaaaagacaaacaguaguaguacuugguagucaagaaggugcuguucacacagcauuggcaggagcauuagaagcagaaauggauggagcuaaaggaagauuaucaucaggacauuuaaaaugcagauuaaaaauggauaaacuaagacuaaaaggaguaaguuauagucuaugcacggcggcauuuacauucacuaaaauaccagcggaaacacuacaugggacaguaacaguagaaguacaauaugcaggaacagauggaccuuguaaaguuccagcucaaauggcaguagauaugcaaacauuaacaccgguagguagauuaauaacagcuaacccaguaauaacagaaaguacugaaaauucaaaaaugaugcuagaacuagauccaccauuuggagacucauauauaguaauaggaguaggagaaaaaaaaauaacucaucauuggcacagaucaggaaguacaauaggaaaggcauucgaagcaacaguaagaggagcuaaaagaauggcaguuuuaggagauacagcaugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7115 - RNA, 1741 nt, Artificial Sequence
  KU312312.1 solE mRNA Design 2 opt
ggggcgcugccuacggagguggcagccaucuccuucucggcaucaagcuuaccaugucacaaaaaguaauauauuuaguaaugauacuacucauagcaccagcuuauaguauaagaugcauuggaguaucaaaucgagauuuuguagaagguaugucaggaggaacauggguagauguaguacuagaacaugguggauguguaacuguaauggcacaagacaaaccaacaguagacauagaauugguaacaacaacaguaaguaauauggcagaaguaagaucauauuguuaugaagcaagcauaucagauauggcaagugacagcagguguccaacucaaggugaagcauaccuagauaaacaaucagauacacaauauguuuguaaaagaacauuagucgacagagguuggggaaaugguugcggacuauucggaaaaggaagcuuaguaacaugugcaaaauuugcauguagcaaaaaaaugacagguaaaucaauucaaccagaaaauuuagaauacagaauaaugcuuaguguacacgguucccaacauaguggaaugaucguaaaugacaccggacaugaaacugaugaaaaucgugcaaaaguagaaauaacaccaaauuccccaagagcugaagcaacacuaggaggauucgguucauuaggauuagauugugaaccuagaacaggauuagauuuuucagaucuauauuaucuaacgaugaauaauaaacauugguuaguacauaaagaaugguuucaugauauaccauuacccuggcaugcuggagcagauacagggacaccacauuggaauaauaaagaagcguuaguugaauuuaaagacgcacaugcaaaaagacaaacaguaguaguacuuggaucacaagaaggcgcaguacauacagcacuagcaggagcacuggaagcugaaauggauggugcaaaggguagacuaucaagcggacaucuaaaauguagacuaaaaauggauaaacuaagacuaaaaggaguuuccuauaguuuguguacagcagcauuuacuuuuacaaaaauaccagcagaaacauuacauggaacaguaacaguagaaguucaauaugcaggaacggauggaccauguaaaguaccagcacaaauggcaguagacaugcaaacauuaacaccaguaggaagauuaauaaccgcuaauccaguaauaacagaaucaacagaaaauucaaaaaugaugcuugaacuugauccaccauuuggagauucauacauaguaauaggaguaggagaaaaaaaaauaacacaucacuggcacagaaguggaucaacaauaggaaaagcauuugaagcaacgguaagaggagcaaaaagaauggcaguauuaggagauacugccugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7116 - RNA, 1729 nt, Artificial Sequence
  AY632535.2 solE mRNA Design 2 opt
ggggcgcugccuacggagguggcagccaucuccuucucggcaucaagcuuaccaugucucaaaaaguaauauauuuaguuaugauauuauuaauagcaccagcauauucaauaagauguauaggaguaucaaauagagacuuuguagaaggaaugaguggaggaacauggguagauguaguacuagaacauggaggauguguaacaguuauggcacaagauaaaccaacgguagacauagaauuaguaacaacuacaguaucaaauauggcagaaguaagaagcuacuguuaugaagcaucaauuagugacauggcaagugacagcagauguccaacacaaggagaagcauauuuagauaaacaaagugauacacaauacguaugcaaaagaacauuaguagacagaggauggggaaauggauguggauuguuuggcaaaggaaguuuaguaacaugugcgaaauuuacuuguaguaagaaaaugacagggaaaucaauacaaccagaaaauuuagaauauagaauaaugcuaaguguacaugguucacaacacucagggaugauugguuacgaaacggaugaagauagagcaaaaguagaaguuacaccaaauagccccagagcagaagcaacguuagguggcuuuggcaguuuaggauuagauugugaaccaagaacaggauuagacuuuagugaucuauauuauuuaacaaugaauaauaaacauugguuaguacacaaagaaugguuccaugauauaccucuaccauggcaugcaggagcagauacaggcacaccgcacuggaauaauaaagaagcauuaguagaauuuaaagaugcacaugcaaaacgacaaaccguagucguauuaggaagucaagaaggggcaguucacacagcauuagcaggagcucuugaagcagaaauggauggagcaaaaggaagauuauucucaggacacuuaaaauguagacuaaaaauggauaaauugagacucaaagguguaucauauagucuguguacagcagcauucacauuuacaaaaguaccugcagaaacauuacaugggacaguaacaguugaaguacaauaugcagguacugauggaccauguaaaaucccuguacaaauggcaguggauaugcaaacucuaacaccaguaggaagacuaauaacagcuaauccaguaauaacagaaagcacagaaaauagcaaaaugauguuagaauuagauccacccuucggagauaguuacauaguaauaggaguuggagauaagaaaauaacacaccacuggcauagaucaggcaguacaauaggaaaagcauuugaagcuacagugagaggugcuaaacgaauggcuguauuaggagauacagcuugggauuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7117 - RNA, 1741 nt, Artificial Sequence
  KU527068.1 solE mRNA Design 2 opt
ggggcgcugccuacggagguggcagccaucuccuucucggcaucaagcuuaccaugagccaaaaaguuauauaucuaguuaugauacuauuaauagccccagcauauaguauaagguguauaggggugaguaacagagauuucguagaaggaaugucaggaggaacauggguagauguaguacuagaacacggaggauguguuacaguaauggcacaagauaaaccaacaguagauauagagcuaguaacgacaacaguaaguaauauggcagaaguucgaucuuauuguuaugaagcaaguauaagugauauggcaagugauucacguuguccaacacaaggagaagcauauuuagauaaacaaagugauacucaauauguuugcaaaagaacauuaguagauagaggauggggaaacgggugugguuuauuugguaaaggaaguuuaguaacaugcgcaaaauuugcauguagcaagaaaaugacuggaaaaaguauacaaccagaaaauuuagaauauagaauaaugcuaagcguacacgguagucaacauagugguaugauugucaaugauacuggacaugaaacagacgaaaauagagcuaaaguagaaauaacaccaaauagcccacgagcagaagcuacacucggaggauuugguucuuuaggauuggauugugaaccucgaaccggacuagauuuuagcgaucucuacuacuuaacaaugaauaauaaacauuggcuaguacauaaagaaugguuucaugauaucccauuaccauggcaugcaggagcagauacaggaacaccacauuggaacaauaaagaagcauugguagaauuuaaagacgcacaugcaaaaagacaaacuguaguaguacuaggaucacaagagggugcuguacauacagcgcuagcaggcgcacuagaagcagaaauggauggugcaaaagggcgauuaaguucaggacaucuaaaauguagauuaaaaauggauaaauuaagacuaaaaggaguaucauauucauuauguacugcugcauuuacauuuacaaaaauaccggcagaaacauuacauggaacaguaacaguagaaguacaauaugcaggaacagacggaccauguaaagucccagcacaaauggcaguugauaugcaaacauuaacaccuguaggaagauuaauaacagcaaauccaguaauaacagaaucaacagaaaacucaaaaaugauguuagaauuagauccuccauuuggugacagcuauauaguaauagguguaggagaaaagaaaauuacacaccauuggcauagaagcggaucaaccauaggaaaagcauuugaggcaacaguaagaggagcaaaaagaauggcaguauugggagacacagcaugggauuucggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7118 - RNA, 1741 nt, Artificial Sequence
  KX421193.1 solE mRNA Design 2 opt
ggggcgcugccuacggagguggcagccaucuccuucucggcaucaagcuuaccaugagccaaaaaguaauauauuuaguaaugauauuacuuauagcuccagcuuauaguauaagauguauaggggucucaaauagagacuuuguugaaggaaugaguggaggaacauggguagacguaguuuuagaacauggaggauguguaacuguaauggcacaagauaaaccgacaguagauauagaauuaguaacaacaaccguaaguaauauggcagaaguaagaagcuauugcuaugaagcaagcaucagugauauggcaagugauaguagauguccaacacaaggagaagcauaccuagacaaacaaagugacacacaauauguauguaaaagaacacuaguagauagaggauggggaaacggaugcggauuauuugguaaagguucauuaguaacaugugcaaaauuuacauguagcaaaaaaaugacaggaaaaagcauucaaccagaaaaucuagaauacagaaucaugcuaucuguacauggaucacaacacagugguaugauaguuaaugauacuggauaugaaacagaugaaaauagggcaaaaguggaaguaacuccaaauagcccaagagcagaagcuacauuaggaggauucggaaguuuaggacuagauugcgaaccaagaacaggacuagacuuuucagaucuauauuauuuaacuaugaauaauaaacauugguuaguacacaaagaaugguuucaugauauaccauuaccauggcacgcaggagcagauacuggaacaccccauuggaauaauaaagaagcacuaguagaauucaaagaugcucaugcaaaaagacaaacuguaguaguauuaggcucacaagaaggagccgugcauaccgcauuagcuggagcucuagaagcugaaauggauggagcaaaagggaaauuauucaguggacacuuaaaaugucgacuaaaaauggauaaguugaggcuaaaagguguaaguuauucauuauguacagcagcauucacauuuacuaaaguaccagcagaaacauugcauggaacgguaacaguggaaguccaauaugcaggaacggauggaccaugcaaaauaccaguacagauggcaguagauaugcagacauuaacaccaguaggaagacuaauaacagcgaauccaguaauaacagaaaguacagaaaauaguaaaaugauguuggaauuagauccccccuuuggagauucauacauaguaauaggaguaggagauaaaaaaauaacucaccauuggcauaggaguggaucaacaaucggaaaagcauuugaagcaacuguaagaggagcaaaaaggauggcaguacuaggagauacagcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7119 - RNA, 1741 nt, Artificial Sequence
  LC002520.1 solE mRNA Design 2 opt
ggggcgcugccuacggagguggcagccaucuccuucucggcaucaagcuuaccaugagucaaaaagucauauauuuaguaaugauauuauuaauugcaccugcauauaguauaagauguauaggaguaaguaauagagacuuuguagaaggaaugagugguggaacauggguagacguagucuuagaacauggaggauguguaacuguaauggcacaagacaaaccaacaguugauauagaauuaguuaccacaacaguaaguaauauggcagaaguaaggaguuauuguuaugaagcaaguaucagugacauggcaagugauagucgauguccaacacaaggagaagcauaucuagauaaacaaucagauacacaauauguauguaaaagaacauuaguagauagaggaugggguaacgguuguggacuauuugguaaaggaagcuuaguaacuugugcaaaauucacauguucaaaaaaaaugacaggaaaaucaauacaaccagaaaaucuggaauacagaauaauguuaucaguacauggaagucaacauaguggaaugacaguaaacgauauaggauaugaaacagaugaaaauagagcaaaaguagaaguaacuccaaauagcccaagggcagaagcaacacuaggagguuuuggaucacugggauuagauugcgaaccaagaacuggacucgacuucagcgauuuauacuauuuaacuaugaauaauaaacauugguuaguucauaaagaaugguuucacgacaucccauuaccauggcacgcaggagcggauacagguacaccacacuggaacaauaaagaggccuuaguagaauuuaaagaugcacaugcaaaaaggcaaacuguaguaguauugggaagucaagagggagcaguacauacagcacuagcaggugcauuagaagcagaaauggacggagcaaaagguaaacuauuuucaggacaucuaaaaugcagauuaaaaauggacaaauuacguuuaaaaggaguaaguuacucacuuuguacagcggcuuuuacauucacaaaaguaccagcagaaacauuacauggcacaguuacaguagaaguacaauaugcaggaacagacggaccauguaaaauaccaguacaaauggcaguagacaugcaaacacuaaccccgguaggaagacuuauaacagcaaauccaguaauaacagaaaguacugaaaauucaaaaaugaugcuagaauuagauccuccauuuggagauucauacauaguaauagguguaggggauaaaaaaauuacacaccauuggcauagauccggaagcacaauaggaaaagcauuugaagcaacgguaagaggagcuaaaagaauggcuguacuaggagauacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7120 - RNA, 1723 nt, Artificial Sequence
  DQ859059.1 solE mRNA Design 2 opt
ggggcgcugccuacggagguggcagccaucuccuucucggcaucaagcuuaccaugucgcaaaaaguuauauaucuaguaaugauauuauuaauagcaccagcuuauaguauaagauguauaggaguaucaaacagagauuuuguagaaggaaugagcggagggacauggguagacguaguauuagaacauggagguuguguaacaguaauggcacaagauaaaccaacggucgauauagaauugguaacgaccacgguaucaaauauggcagaaguaagaaguuauuguuaugaagcauccauaagcgauauggcaagcgauaguagauguccaacacaaggagaagcauaucuugauaaacaaucagauacccaauauguauguaaaagaacauuaguagauagaggauggggaaaugguuguggauuguucggaaaaggauccuuaguaacaugcgcaaaauuuacauguagcaaaaaaaugacuggaaaaaguauacaaccugaaaaucuagaauauagaauaauguuaucuguacauggaagucaacauucaggaaugauuguaaaugacgaaaauagagccaaaguagaagugacaccaaauagcccaagagcagaagcaacauuaggagguuuugguagcuuaggauuagacugugaaccacgaacagggcuggacuuuucagacuuauauuaucuaacuaugaauaauaaacauuggcucguacauaaagaaugguuucacgauauaccacuaccauggcaugcaggagcagauacaggcacaccacauuggaauaauaaagaagcauuaguagaauucaaagacgcacacgcaaaaagacaaacaguaguaguacuaggaucacaagaaggagcaguacauacagcuuuagcaggagcucuagaagcagaaauggauggagcaaaagguagacuauucagcggacauuuaaaauguagauuaaaaauggauaaacuaagguuaaaaggaguaaguuauaguuuauguacagcagcauuuacauuuacgaaaguaccagcagaaacauugcacggaacagugacaguugaaguacaauaugcgggaacagacggaccaugcaaaguaccagcacagauggccguagauaugcaaacauuaacaccaguaggucgacuaauaacugcaaauccaguuauuacagaaucuacagaaaauagcaaaaugaugcuagaguuagauccuccauucggagacaguuauauaguaauaggaguuggagauaaaaaaauaacacaucauuggcauagaaguggaaguacaauaggaaaagcauuugaagcaacaguaagaggagcuaaaagaauggcuguuuuaggagauacagcaugggacuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7121 - RNA, 1729 nt, Artificial Sequence
  KU963573.2 solE mRNA Design 2 opt
ggggcgcugccuacggagguggcagccaucuccuucucggcaucaagcuuaccaugucacaaaaaguaauauacuuaguuaugauacuauuaauagcaccugcuuacagcauacgaugcauugguguaagcaaucgugacuuuguagagggaaugagcgguggaacauggguagacguaguauuagaacacggaggauguguaacaguaauggcgcaagauaaaccaaccguagauauagaauuaguuacaacaacaguaucaaauauggcagaaguaagaucauauuguuaugaagcaagcauaucagauauggcaagugacagucgaugcccaacacaaggagaagcauauuuagauaaacaaagcgauacacaauacguauguaaaagaacauuaguagauaggggauggggcaacgguugcggauuauucggcaaaggaagccuaguuacaugugccaaauuuacauguaguaaaaaaaugacuggaaaaucaauacaaccugaaaauuuagaauauagaauuaugcuaaguguacacggaagccaacacucaggaaugauuggauacgaaacagaugaaaacagggcuaaaguagaagucacaccaaauucaccaagagcagaagcaacacuuggaggcuucgguucgcuaggacucgauugugaaccaagaacaggacuagacuuuucugacuuauauuaucuaacaaugaauaauaaacauuggcuaguacauaaagaaugguuccacgauauaccauugccauggcacgcaggugcagauacaggaacaccacauuggaauaacaaagaagcauuaguagaauuuaaagacgcccaugcuaaaagacaaacaguaguaguacuaggaagucaagagggugcaguccauacagcauuagcaggagcacuagaagcagaaauggauggggcuaaagguaaauuauuuaguggacauuuaaaauguagauuaaaaauggacaaauuaagauuaaaaggaguaaguuacagcuuauguacagcagccuucacauuuacaaaaguaccagcagaaacauuacauggaacaguuacaguagaaguacaauaugcaggaacagauggaccauguaaaauaccaguccaaauggcaguagauaugcaaacauuaacaccaguaggaagauuaauaacagcaaauccuguaauaacagaaaguacagaaaauagcaaaaugauguuagaacuagauccaccauuuggugacaguuauauagugauaggaguuggagacaaaaaaauaacacaucauuggcaucgaucaggaaguacaauuggaaaagcauucgaagcaacuguaagaggagcaaaaagaauggcugucuuaggggacacagcaugggauuucggcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7122 - RNA, 1741 nt, Artificial Sequence
  KY075939.1 solE mRNA Design 2 opt
ggggcgcugccuacggagguggcagccaucuccuucucggcaucaagcuuaccaugucucaaaaaguaauauauuuaguuaugauacuauugauagcucccgcauauagucuaagauguauaggaguaagcaauagagauuuuguagaaggaaugagcgguggaacauggguagauguaguauuagaacauggaggauguguaacaguuauggcacaagauaaaccaacaguagauauagaauuaguaacaacaacaguaucaaauauggcagaaguaagaucauauuguuaugaagcaaguauaagcgauauggcuucagauaguagaugcccaacccaaggagaagcauaccuagauaaacaaagugauacacaauacguauguaaaagaacguuaguagauagaggauggggaaauggaugcggauuauuuggaaaaggaagucuaguaacaugugcuaaauuugcauguucaaagaaaaugacaggaaaaucaauucaaccagaaaauuuagaauauagaauaauguuaagcguacaugguucacaacauaguggaaugaucguaaaugauacaggacaugaaacagaugaaaaucgagcuaaaguagaaauaacaccuaacaguccaagagcagaagcaacauuaggaggauuuggaaguuuaggauuggauugcgaaccaagaacagguuuagauuucucagauuuauauuaucuaacaaugaauaacaaacauugguugguacauaaagaaugguuucaugauauaccucuaccuuggcaugcaggagcagacacgggaacaccacacuggaauaauaaagaagcauuaguagaauuuaaagaugcucaugcaaaaagacaaacuguaguaguauuaggaagucaagaaggagcaguucauacagccuuagcaggagcauuagaagcagaaauggauggagcuaaaggaagauuaucaaguggacauuugaaaugcagauugaaaauggauaaauuaagauuaaaaggaguaucauauagucuauguacagcagcauuuacauuuacaaaaauaccagcggaaacacuacauggcacaguuacugucgaaguacaauaugcaggaacagacgguccauguaaaguaccagcacaaauggcagucgauaugcaaacauuaacaccagugggaagauuaauaacagcaaauccaguaauaacugaaucaacugaaaauucaaaaaugaugcuagaauuagauccacccuucggugauucguacauaguaauaggaguuggggaaaagaaaauaacacaucauuggcauagaucaggaaguacaauuggaaaagcauucgaagcuacuguuagaggcgcuaaaagaauggcaguauugggagauacagcaugggauuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7123 - RNA, 1741 nt, Artificial Sequence
  KX447516.1 solE mRNA Design 2 opt
ggggcgcugccuacggagguggcagccaucuccuucucggcaucaagcuuaccaugagcaaaaaaguaauauaccuaguaaugauauuacuaauagcaccagcauacaguauacgauguauaggaguaaguaacagagauuuuguugaaggaaugucaggaggaacauggguugauguaguauuagaacacggcggauguguaacaguaauggcacaagauaaaccaacaguugauauagaauuaguaaccacaacaguuagcaauauggcugaaguaagaucauauuguuaugaagcaucaauaucagauauggcaagugauucaagauguccaacacaaggugaagcauaucuagacaaacaaucagauacacaauacguauguaaaagaacacuagucgauagaggauggggaaauggaugcgguuuauucggaaaagggucacuaguuacaugugccaaauuugcaugcagcaaaaaaaugacuggaaaaucaauucaaccagaaaaucuugaauauagaauaauguuaucaguacaugguucacaacauagcggaaugauuguuaacgacaccggacaugaaacagaugaaaaucgagcaaaaguagaaauaacuccaaacucaccaagagcugaagcaacauugggaggauucggaucauuaggacuagacugugaaccaagaaccggauuagauuuuucagacuuauauuauuuaacaaugaauaacaaacauugguuaguacacaaagaaugguuucacgacauaccacuaccauggcacgcaggagcugauacagguacaccacauuggaauaacaaagaagcucucguagaauuuaaagaugcacaugcaaaacgacaaacuguagucguauuaggaucucaagaaggagcuguacauacagcacuagcaggagcauuagaagcagaaauggauggagcuaaaggaagauuaagcucaggccaucucaaaugccgauuaaaaauggauaaauuaagauuaaaaggaguaucauauucauuauguacagcagcauucacauuuacaaaaauuccagcugaaacauuacaugguacuguaacaguagaaguacaauaugccgguacagaugguccauguaagguaccugcacaaauggcaguagauaugcaaacauuaacaccaguaggaagacuaauaacagcaaauccuguaauaacagaaaguacagaaaauucaaaaaugaugcuagaauuagacccaccguucggcgauaguuauauuguaauaggaguaggagaaaaaaaaauaacucaccauuggcauagaucaggcucaacaauaggaaaagcauuugaagcaacaguaagaggagcuaaaagaauggcuguucuaggagacacagcaugggauuuugguucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7124 - RNA, 1741 nt, Artificial Sequence
  KX447515.1 solE mRNA Design 2 opt
ggggcgcugccuacggagguggcagccaucuccuucucggcaucaagcuuaccaugagccaaaaaguaaucuauuuagucaugauauuauugauagccccagcauacucuauaagauguauaggaguaaguaauagagacuucgucgaaggaaugaguggaggaacauggguagauguaguucuagaacauggaggauguguaacaguaauggcucaagacaaacccacaguagauauagaauuaguaacaacaacaguaagcaauauggcagaaguacgaaguuauugcuaugaagcaucaauaucagauauggcaucagauucaagauguccaacccaaggagaagcuuaucucgauaaacaaucagauacacaauauguauguaaaagaacucuaguagauaggggauggggaaaugguugcggucuauuuggaaaaggaaguuuagucacaugugcaaaauuugcaugcaguaaaaaaaugacaggaaaaucuauacaaccagagaacuuagaauauagaauaauguugaguguacacgguagucaacauagugguaugauagucaaugauacaggacaugaaacagaugaaaauagagcaaagguagaaauaacgccaaauucaccaagagcagaagcaacauuaggaggauuuggaagcuuaggacuagacugugaaccacgaacgggauuagauuuuagugaccuauauuauuuaacaaugaauaacaaacauuggcugguucauaaagaaugguuucacgauauaccacuaccauggcaugcuggagcagauacagguacaccacacuggaacaauaaagaagcauuaguagaauuuaaagacgcucaugcaaaaagacaaacgguaguagucuuaggaucacaagaaggagcaguacacacagcauuagcgggagcacuagaagcagaaauggauggugcaaaaggaagauuaaguaguggacaucuaaaauguagauuaaaaauggauaaauuaagguuaaaaggaguaaguuauucauuauguacggcggcauuuacauuuacaaaaauaccugcagaaacguuacauggaacaguuacagucgaaguucaauaugcuggaacagauggacccuguaaaguuccagcacaaauggcgguagauaugcaaacauuaacaccaguuggaagauuaaucacagcaaauccaguaauaacagaaaguacagaaaauaguaaaaugaugcuugaauuagauccaccauucggagauagcuauauaguaauuggaguaggugaaaaaaaaauaacgcaucauugguauagaucaggaucaacaauaggaaaagcauuugaagcaacuguaaggggagcaaaacguauggcaguauugggagauacagccugggacuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7125 - RNA, 1741 nt, Artificial Sequence
  KU758874.1 solE mRNA Design 2 opt
ggggcgcugccuacggagguggcagccaucuccuucucggcaucaagcuuaccaugucacaaaaaguaauauaucuaguaaugauauuacuuauagcuccugcauauaguauacgaugcauaggggugucaaauagagauuuuguagaaggaaugagugggggaacauggguagauguaguacuagaacacggagguuguguaacagucauggcacaagauaaaccgacuguggauauagaacuuguaacaacuacaguaucaaauauggcagaaguaagaaguuauugcuacgaagcaaguauaagcgacauggcaagcgauuccagguguccaacacaaggagaagcauaccuagauaaacaaagcgauacucaauauguauguaaaagaacgcucguagauagaggcuggggaaauggauguggauuauuugguaaagggaguuuaguuacaugugcuaaauuugcaugcaguaagaaaaugacaggaaaaaguauacaaccagaaaauuuagaauaucgaauaauguugucaguucauggaagucaacauucaggaaugauaguaaaugauacaggacaugaaacagaugaaaauagagcgaaaguugaaauaacaccaaauucaccaagagcagaagcaacacuagggggauuugggucacuaggacuagauugugaaccaagaacaggauuagauuuuucagaucucuacuaccuaacaaugaacaauaaacacugguuaguacauaaagaaugguuucacgacaucccauuaccauggcaugcaggagcagauacaggaacgccacauuggaauaacaaagaagcauuaguagaauuuaaagaugcccaugcuaaaagacaaacaguuguaguacuugguucacaagaaggugcaguacacacagcauuagcaggagcauuagaagcagaaauggauggagcaaaaggaaaacuaagcucuggacaucuaaaaugcagacuaaaaauggauaaauuaagauuaaaaggaguaagcuauagucuaugcacagcagcauucacuuucacaaaaauaccagcagaaacauuacacggaacaguaacgguagaaguacaauaugcaggaacugacggaccauguaaagugccagcacaaauggcaguagauaugcagacauuaacaccaguagguagauuaauaacagcaaacccggugauuacugaaagcacugaaaauaguaaaaugauguuagaacuagauccaccuuuuggagauaguuauauaguuauaggaguaggagaaaagaaaauaacacaccacuggcacagaucaggaucaacaauaggaaaagcauuugaagcaacaguaagaggagcaaaaagaauggcuguacuaggagauacagcaugggacuuugguaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7126 - RNA, 1741 nt, Artificial Sequence
  KU729218.1 solE mRNA Design 2 opt
ggggcgcugccuacggagguggcagccaucuccuucucggcaucaagcuuaccaugucacaaaaaguaauauauuuaguaaugauacuccucaucgcaccagcauacucaauaagauguauaggaguaucaaacagagacuuuguagaaggaauguccggaggaacuuggguugauguuguauuagaacauggaggauguguaaccguaauggcacaagacaaaccaacaguagauauugaacuaguaacaacaacaguaucaaauauggcagaaguuagaaguuauuguuacgaagcaucaauaucagauauggcaucagauucaaggugcccaacacaaggagaagcauauuuagacaaacaaucagacacacaauauguaugcaaaagaacacuggucgauagaggauggggaaacggauguggauuguucggaaaaggaucauuaguuaccugugcaaaauucgcaugcagcaaaaaaaugacaggaaaaaguauacaaccagaaaauuuagaauacagaauaauguuaaguguucacggaucacaacauaguggaaugauuguuaacgacacaggacacgaaacagaugaaaauagagcaaaaguagaaauaacgccaaauucgccaagagcagaagcaacauuagguggauuuggaagcuuagguuuagauugugaaccaagaacaggacuugauuuuagcgauuuauacuaccuaacaaugaauaauaaacauugguuaguucacaaagaaugguuucaugauauaccauuaccauggcacgcaggagcagauacaggaacaccacacuggaauaacaaagaagcacuugucgaauuuaaagaugcgcacgcaaaaagacaaacaguaguuguucuaggaucacaagaaggagcaguacauacagcucuagcuggagcacuagaagcagaaauggacggagcaaaaggcagauuauccaguggacauuuaaaauguagacuaaaaauggacaaauuaagacuuaaaggaguuaguuauucacuauguacagccgcauucacauucacaaaaauuccagcagaaacacuacauggaacaguaacagucgaaguacaauaugcaggaacagauggaccauguaaaguaccggcacaaauggcuguagacacucagacauuaacaccaguaggaagguuaauuacagcaaauccaguaauaacugaaucaacagaaaauagcaaaaugauguuagaauuagauccaccauuuggugauaguuauauuguuauaggaguaggagaaaaaaaaauaacacaucauuggcaucgaucaggaagcacaauaggaaaagcauuugaagccacuguaagaggagcaaaaagaauggcaguacucggugauacagcgugggacuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7127 - RNA, 1741 nt, Artificial Sequence
  KU501217.1 solE mRNA Design 2 opt
ggggcgcugccuacggagguggcagccaucuccuucucggcaucaagcuuaccaugucacaaaaaguaauauaccuaguaaugauauuauuaauagcuccagcauauaguauaagaugcauaggaguaaguaaucgagauuuuguagagggaaugagcggggguacauggguagacguaguauuggaacacggaggauguguaacaguaauggcacaagacaaaccaacaguagacauugaacugguuacgaccacuguaucaaauauggcagaaauaagaucauacugcuaugaagcgaguauaagugauauggcaucagauucuagauguccaacacaaggagaagcauaucuagacaaacaaagugauacacaguauguauguaaaagaacgcuaguagauagaggauggggaaauggauguggucuauuugggaaagguagcuuaguaacaugugcaaaauuugcaugcaguaaaaaaaugacaggaaaaucaauucaaccagaaaauuuagaauauagaauaauguuaucugugcauggaucacaacauucaggaaugauagugaacgauacaggacacgaaacugaugaaaauagagcaaaagucgaaauaaccccaaauucacccagagccgaagcaacauuaggaggauuuggaucacuaggccuugauugugaaccaagaacaggauuagacuuuucagacuuguauuaucuaacaaugaauaacaaacauugguuaguacauaaagaaugguuucaugauauaccauuaccuuggcaugcaggagcagauacggguacaccacauuggaauaauaaagaagcccucguagaauuuaaagaugcacaugcuaaaaggcaaacuguuguaguacuagguagucaagaaggagcuguacauacagcauuagcaggagcauuagaagcagaaauggacggggcaaaagguaggcucaguucaggacaccuaaaaugcagauuaaaaauggauaaauuaagacuaaaaggcguaaguuauaguuuauguacagcagcauuuacauucacaaaaauaccagcagaaacguuacauggaacaguaacaguagaaguacaauaugcaggaacagauggaccuugcaaaguuccagcacaaauggcaguagauaugcaaacacuaacaccaguaggaagacuaauaaccgcaaauccaguaauaacagagagcacagaaaauagcaaaaugaugcuagaauuagacccaccauucggagauuccuauauaguaauaggaguaggugaaaaaaaaauuacacaucacuggcaccgaucaggaucaacaauagguaaggcuuucgaagcaacaguaagaggagcuaaacguauggcaguauuaggagauacugcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7128 - RNA, 1741 nt, Artificial Sequence
  KU761561.1 solE mRNA Design 2 opt
ggggcgcugccuacggagguggcagccaucuccuucucggcaucaagcuuaccaugucacaaaaaguaauauacuuaguuaugauuuuguuaauagcaccagcauauucaauaagaugcauuggaguaucaaauagagauuucguagaaggaaugagcggaggcacauggguagauguaguauuagaacaugguggauguguuacuguaauggcacaagauaaaccaacuguagacauagaacuaguaacaacaacaguaucaaauauggcagaaguaagaaguuauuguuaugaagcaagcauauccgauauggccucagacaguagauguccaacacaaggagaagcuuacuuagauaaacaaucagauacacaauauguauguaaaagaacacuaguagacagaggauggggaaauggaugcgguuuauucggaaaaggaagucuaguaacaugcgcaaaauuugcauguaguaaaaaaaugacaggaaaaaguauacaaccagaaaauuuagaauacagaauaaugcuaaguguccauggaagucaacauaguggaaugauuguaaaugacacaggacaugaaacagaugaaaauagagcgaaaguagaaauaacaccaaacucaccaagagcagaagcaacauuaggaggauuuggaucauuaggucuugauugugaaccaagaacuggacuugauuuuucagauuuauauuaccuaacaaugaauaauaaacacuggcugguacauaaagaaugguuccaugacauaccucuacccuggcacgcaggagcagauacagguaccccacauuggaauaauaaagaagcauuaguagaguucaaagaugcacaugcaaaaagacaaacaguaguuguauuaggaucacaagaaggagcaguacauacagcacuagcaggagcauuagaagcagaaauggacggcgcaaaaggcagacuuagcaguggacaccuaaaaugccgcuuaaaaauggauaaacuaagauuaaaaggaguaaguuauucauugugcacagcagcauucacauucacaaaaauacccgcagaaacacuacacgguacaguuacaguugaaguacaauaugcaggaacagauggaccauguaaaguuccagcacaaauggcaguagauaugcaaacauuaacaccaguaggucgauuaauaacagcaaacccaguaauuacagaaucaacagaaaauaguaaaaugauguuagaacucgaccccccauucggagacucauacauaguuauaggaguaggugaaaaaaaaauuacacaucacuggcacagaucaggaucaacaauaggaaaagcuuuugaagcaacaguuagaggagcacgaagaauggcuguauuaggagauaccgcgugggacuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7129 - RNA, 1741 nt, Artificial Sequence
  KY075937.1 solE mRNA Design 2 opt
ggggcgcugccuacggagguggcagccaucuccuucucggcaucaagcuuaccaugucucaaaaaguuauauauuuaguaaugauuuuauuaauagcaccagcauauucaauuagauguauaggaguaucaaauagagauuuuguagagggaaugucuggaggaacauggguagauguaguucuagaacauggaggauguguaaccguaauggcgcaagauaaaccaacugucgauauagaauuaguaacaacaaccguuucaaauauggcagaaguaagaucauauuguuaugaagcaucaauaagugauaugguaagcgacucaagauguccaacacaaggagaagcauaucuggauaaacaaucggacacgcaauauguauguaaaaggacucuaguugauagaggauggggaaauggaugcgguuuauuugguaaaggaaguuuaguaacaugcgcaaaauuugcauguucaaaaaaaaugacaggaaaauccauacaaccugaaaauuuagaauacagaauaauguuaucaguacauggaagucaacauucaggaaugauaguaaacgacacaggacaugaaacagaugaaaacagagcuaaaguggaaauaacaccgaauagcccaagagcagaggcaacauuaggaggauuuggaucacugggauuagauugugaaccaagaacaggcuuagauuuuagcgacuuauacuauuuaacaaugaauaauaaacauuggcuagugcauaaagaaugguuccacgauauaccauuaccguggcaugcaggagcagauacaggaacaccacauuggaauaacaaagaagcuuuaguagaauuuaaagacgcccaugcaaaaagacaaacgguaguaguauugggaucacaagaaggugcaguacauacagcacuagcaggagcauuagaagcagaaauggauggcgcaaaaggaagacuaucgucaggacacuuaaaauguagauuaaagauggacaaacuuagauuaaaaggcguaaguuauucauugugcacagcagcauuuacauuuacaaaaauaccugcagaaacauuacauggaacaguaacuguagaaguacaauaugcaggaacagacgguccaugcaaaguaccagcacaaauggcaguagauaugcaaacacuaacaccaguaggaagacuaauaaccgcaaauccagucauaacagaaucaacagaaaauagcaaaaugaugcuagaauuagauccuccauucggagauagcuauauagucauagggguuggggaaaaaaaaauuacucaccacuggcauagaaguggaagcaccauaggaaaagcauuugaagcaacaguaagaggagccaaaagaauggcaguguuaggagauacggcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7130 - RNA, 1741 nt, Artificial Sequence
  KY014317.1 solE mRNA Design 2 opt
ggggcgcugccuacggagguggcagccaucuccuucucggcaucaagcuuaccaugagucaaaaaguaauauaccuaguaaugauacuauuaauagcaccugcauauaguauaagauguauaggaguaucaaauagagauuucguagaaggaaugucaggaggcacauggguagacguaguuuuagaacauggaggauguguaacuguaauggcacaagauaaaccuacuguagauauagaauuaguaacaacaacaguaucaaacauggcagaaguaagaaguuauuguuaugaagcaagcauaucugauauggcaucagacucaagaugcccuacacaaggagaagcguacuuagacaaacaaagcgauacacaauauguauguaaaagaacacucguagauagaggaugggggaacggaugugguuuauucgggaaaggaucccuaguaacaugugcaaaauuugcauguaguaaaaaaaugacagggaaaucaauacaaccugaaaaccuagaauauagaauaauguuaagcguacauggaucacaacauucaggaaugauuguaaacgacacaggacaugaaacagaugaaaauagagcaaaaguagaaauuacaccaaauucaccaagggcugaagcaacauuaggagguuuuggaaguuuaggauuagauugugaaccaagaacaggacuagauuucagugauuuguacuacuuaacaaugaauaauaaacauuggcuuguucauaaagaaugguuccaugauauaccacuaccauggcacgcaggagcagauacuggaacaccucacuggaacaauaaagaagcacuaguugaauucaaagacgcccaugcaaaacgacaaacugucguaguauuaggaucacaagaaggagcaguacauacagcauuagcaggagcauuagaagccgaaauggauggagcuaaaggaagauuaucaucaggacaucuaaaguguaggcuaaaaauggacaaacuaagauuaaaaggagugaguuacaguuuauguacagccgcauuuacauuuacaaaaaucccagcagaaacacugcauggaacuguaacaguugaaguacaauaugcaggaacagaugggccaugcaaaguaccagcacaaauggcaguagauaugcaaacacuaacaccaguaggaagguuaauaacagcuaauccaguaauaacagaaaguauagaaaauaguaaaaugauguuagaacuagacccaccuuucggugauucuuauauaguaauaggaguaggugaaaaaaaaauaacacaucauuggcauagaucuggaaguaccauaggaaaagcauuugaagcuacaguaagaggagcuaaaagaauggcaguauuaggagauacagcaugggauuucgguaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7131 - RNA, 1741 nt, Artificial Sequence
  KU870645.1 solE mRNA Design 2 opt
ggggcgcugccuacggagguggcagccaucuccuucucggcaucaagcuuaccaugucacaaaaaguaauauaccuaguaaugauauuacuaauagcaccagcuuacucaauaagauguauagggguaucaaauagagauuuugucgaaggaaugucuggaggaacauggguagaugucguacuugaacacggaggauguguaacaguaauggcacaagauaaaccaacaguagauauagaauuaguuacaacaacaguaucaaacauggcugaaguaagaucauacuguuacgaagccucaauuucagauauggcaagugauucuagguguccaacgcaaggagaagccuauuuagauaaacaauccgauacacaauauguuuguaaaagaacuuuaguagauagaggaugggguaacggauguggauuauucggaaaagggucucuaguaacaugugcaaaauuugcauguaguaaaaaaaugacaggaaaaucaauacaaccugaaaaucuagaauacagaauaauguuaaguguacauggaagccaacauucaggaaugauaguaaaugauacaggacaugaaacagaugaaaaccgugccaaaguagaaauaacaccaaacucaccacgagcagaagcaacuuuaggaggauuugggucacuaggacuagacugugaaccaagaacuggacuugacuuuucugaucuauauuauuuaaccaugaauaacaaacacuggcuuguacacaaagaaugguuccaugauaucccauuaccauggcacgcaggagcagauacaggaacaccccauuggaauaauaaagaagcauuaguagaauuuaaagaugcacacgcaaaacgacaaacagucguuguauuaggaucacaagaaggagcaguacauacagcacuagcaggagcacuagaagcagaaauggauggagcaaaaggaagauuaucaagcggacaccuaaaauguagacuaaaaauggauaaauuaagauuaaaaggaguaaguuauaguuuauguacagcagcauucacauucacaaaaauaccagcagaaacacuacauggaacagucacaguagaaguacaauaugcuggaacagauggaccuuguaaaguaccagcacaaauggcaguagauaugcaaacauuaacuccaguaggaagauuaauuacagcaaauccuguaauaacagaaucaaccgaaaacucaaaaaugauguuagaauuagacccaccauuuggagacucauauauagucauaggaauaggcgaaaaaaaaauaacacaucacuggcacagaaguggcucaacaauaggaaaagcauuugaagcgacaguaaggggagcaaaaagaauggccguauuaggagacaccgcaugggacuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7132 - RNA, 1741 nt, Artificial Sequence
  KU922923.1 solE mRNA Design 2 opt
ggggcgcugccuacggagguggcagccaucuccuucucggcaucaagcuuaccaugucgcaaaaaguaauauaucugguuaugauuuuguuaauagcauuagcauacucaauaagaugcauaggaguaaguaauagggauuuuguagaaggaaugaguggagguacauggguagauguaguauuagaacaugguggaugcguaacaguaauggcacaagauaaaccuacaguagacauagaauuaguaaccaccacaguuucaaacauggcagaagucagaucauacuguuacgaagcaagcauauccgauauggcaucagacucuagauguccaacccaaggugaagcauauuuagacaaacaaucagacacacaauauguauguaaacgaacuuuaguagauagaggauggggaaaugguugcggauuauuuggaaaaggaucauuaguaacaugugcaaaauucgcaugcaguaaaaaaaugacuggaaaaucaauacaacccgaaaauuuagaauauagaauaauguuaaguguucauggcagucaacauagugguaugauaguaaaugacacaggacaugaaacagaugaaaacagagcaaaaguugaaauaacaccaaacucuccaagagcagaagcaacauuaggagguuuugguaguuuaggacuagauugugaaccaagaacuggauuagauuuuucagaucuauauuauuugacaaugaauaauaaacauugguuaguucacaaagaaugguuccaugauauaccacuaccauggcaugcaggagcagauacaggaacaccacauuggaauaauaaagaagcauuaguggaauuuaaagaugcacaugcaaaacgacaaacaguaguuguacuaggaucacaagaaggagcaguacacacggcauuagcaggagcauuagaagcagaaauggauggggcaaaaggaagguuaagcuccgggcauuuaaaaugccgauuaaaaauggacaaauuaagauuaaaaggugugucuuauagucuauguacagcagcauuuacauuuacaaaaauaccggcagaaacacuucaugguacaguaacaguagaaguacaauaugcaggaacagauggcccauguaaagugccagcacaaauggcaguagacaugcaaacacuaacaccagucggaagauuaauaacugcaaauccaguaauaacagaaucaacagaaaacaguaaaaugauguuagaauuagacccuccguucggagacuccuauauaguaauaggaguaggugaaaaaaaaauaacacaucauuggcauagaucaggaucaacaauaggaaaagccuuugaagcaacaguaagaggagcaaaaagaauggcaguacuaggagacacagcaugggacuuuggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7133 - RNA, 1741 nt, Artificial Sequence
  KU497555.1 solE mRNA Design 2 opt
ggggcgcugccuacggagguggcagccaucuccuucucggcaucaagcuuaccaugucacaaaaaguaauuuacuuaguuaugauacuacuuauagcaccagcauauucaauaagauguauaggaguaucaaauagggacuuuguagaaggaaugaguggugguacuuggguagacguaguauuagaacacggaggauguguaacuguaauggcgcaagauaaaccaacaguagacauagaauuaguuacaaccaccguaaguaauauggcagaaguaagaaguuauugcuacgaagcaaguauaucagacauggcaagugauucaagauguccaacucaaggugaagcauauuuagauaaacaaucagauacacaauauguauguaaaagaacucuaguagacagaggaugggguaauggaugcggcuuauucggaaaaggauccuuaguuacaugugcuaaauuugcuuguaguaagaaaaugacaggaaaaaguauucaaccagaaaacuuagaauacagaauaauguugagcguacaugguagucagcauucaggaaugauagucaaugauacaggacaugaaacagaugaaaauagagcaaaaguagaaauaacaccaaauaguccaagagcagaagcgacauuaggaggauuuggaagccuaggacuagacugugaaccaagaaccgguuuagauuucuccgauuuauacuauuuaacaaugaacaacaaacacuggcuaguccauaaagaaugguuucaugauauuccacuaccauggcaugcaggagcagacacggguacaccacacuggaauaauaaagaagcauuaguagaauuuaaagaugcacaugcaaagagacagacaguaguuguauuaggaacacaagaaggugcaguacacacagcacuagcuggugcacuagaagcagaaauggauggagcaaaaggccgacuaaguaguggacaccuuaaauguagauuaaaaauggauaaauuaagauuaaaaggaguuucuuauaguuuauguacagcagcauucacauuuacaaaaauaccagcugaaacauuacacggaacaguaacaguugaaguucaauaugcaggaacagauggaccauguaaaguaccugcgcaaauggcuguagauaugcaaacguuaacaccaguaggaagauuaauaacugcaaacccaguuauaacagaaucuacagaaaauaguaaaaugauguuagaauuagacccuccauuuggcgauaguuauauaguaauaggaguaggagaaaagaaaauaacacaccacuggcauagaucaggaaguacaauaggaaaagcauuugaagcuacaguacgaggcgcuaaaaggauggcuguauuaggugauacagcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7134 - RNA, 1741 nt, Artificial Sequence
  KU312314.1 solE mRNA Design 2 opt
ggggcgcugccuacggagguggcagccaucuccuucucggcaucaagcuuaccaugagccaaaaaguuauauauuuaguuaugauacuauuaauagcaccagcuuacaguauaagauguauaggaguaaguaauagagauuuuguagaggguaugucaggaggaacauggguagacguaguauuagaacauggaggauguguaacaguaauggcacaagauaaaccaacaguagauauagaacuaguaacgacaacaguaucaaauauggcugaaguuaggucauauuguuaugaagcaaguauuagugacauggcaucagauagcagauguccaacacaaggagaagcauaucuagacaaacaaagugauacacaauauguaugcaaaagaaccuuaguagauagaggauggggaaacggcuguggucuauuuggaaaaggaucauuaguaacaugcgcaaaauuugcaugcaguaaaaaaaugacaggaaaaucaauacaacccgaaaaucuagaauauagaauaauguuaaguguacauggaucacaacacucgggcaugauaguaaaugauacaggacaugaaacagaugaaaauagagcgaaaguagaaauaacaccaaauaguccuagagccgaagcaacguuaggaggauuuggcucacuuggacuggauugugaaccaagaaccggacuagauuuuucagauuuauauuauuuaacaaugaacaauaaacauugguuaguacacaaagaaugguuucaugauauccccuuaccauggcacgcaggugcagauacaggaacaccacauuggaauaauaaagaggcauuaguagaauuuaaagacgcacaugcaaaaagacaaacaguaguaguauuaggaagucaagaaggagcaguacauacagcauuagcuggagcccuagaagcggaaauggacggagcaaaaggaagguuaucaaguggacauuuaaaauguagacuaaaaauggauaaauuaagacuaaaaggaguaucauacagcuuguguacagcagcauuuacauuuacaaaaauaccagcagaaacauuacacgguacaguuacaguagaaguacaauaugcaggaacagacggaccuugcaaaguauuagcacaaauggccguagauaugcaaacacuaacaccaguaggaagauuaauaacagcaaauccaguaauaacagaaagcacagaaaacaguaaaaugauguuagaacucgauccacccuucggagauuccuacauagucauaggugugggagaaaaaaaaauuacacaucauuggcauagaagcggaagcacaauaggcaaagcauuugaagcaacagucagaggagcaaagcgaauggcaguucuaggagacacagccugggauuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7135 - RNA, 1741 nt, Artificial Sequence
  KY014314.1 solE mRNA Design 2 opt
ggggcgcugccuacggagguggcagccaucuccuucucggcaucaagcuuaccaugagccaaaaaguaauauauuuaguaaugauauuacuaauagcaccagcauauaguauacgcuguauuggaguaucgaaucgagacuuuguagaaggaaugagcggaggaacauggguagauguaguacuagaacacggaggauguguuaccguuauggcacaggauaaaccaacaguagauauagaauuaguaacaacaacaguuaguaauauggcagaaguaagaagcuauuguuacgaagcaucaauaagcgacauggcaagcgauaguagaugcccaacacaaggagaagcauauuuagauaaacaaagugauacucaauauguaugcaaacgaacauuaguagacagaggauggggaaauggauguggauuauuuggaaaaggaagucuaguuacaugcgcaaaauuugcuuguagcaagaaaaugacaggaaaaucaauacaaccagaaaacuuggaauauagaauaauguuaucuguacauggaucacaacauucaggaaugauaguaaacgauacuggacacgaaacagaugaaaauagagcaaaaguugaaauuacacccaauagcccaagagcagaagcaacauuagggggauucggaucauuaggauuagacugugaaccaagaacaggauuagacuucucagauuuguauuauuuaacaaugaauaauaaacacuggcuaguacacaaagaaugguuucaugauauaccucucccauggcacgcaggagcugauacaggaacaccacacuggaauaacaaagaagcauuaguagaauuuaaagaagcacaugcaaaaagacaaacuguuguaguacuaggaagucaagaaggagcaguacacacugcauuagcaggagcuuuagaagcggaaauggauggagcaaaaggaagauuaucaaguggacaucuaaaauguagacuaaaaauggauaaacuaagauuaaaaggcguaaguuauagucuauguacggcugcguucacauucacaaaaauaccagcagaaacauuacacggaacaguaacaguagaaguacaauaugcaggcacagauggacccugcaaaguaccagcacaaauggcaguagauaugcaaacauuaacaccaguaggaagacuaauaacagcaaauccuguaauaacagaaaguaccgaaaauaguaaaaugauguuagaacuagauccaccauuuggagauaguuauauaguaaucggaguuggagaaaagaaaauaacucaucacuggcacagaagcgguaguaccauagguaaagcauuugaagcuacagugcgaggagcaaaaagaauggcaguuuuaggagauacagcaugggauuuuggaaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7136 - RNA, 1741 nt, Artificial Sequence
  KX447517.1 solE mRNA Design 2 opt
ggggcgcugccuacggagguggcagccaucuccuucucggcaucaagcuuaccaugucacaaaaaguaauauacuuaguuaugauauuacucaucgcuccggcauauaguauaagauguauuggaguaucaaauagagauuuuguagaaggaaugucaggaggaacauggguagaugugguauuagaacauggcggaugcguaacaguaauggcacaagauaaaccaacaguagacauagaauuagucaccacaacagucagcaauauggcagaaguaagaagcuauugcuaugaagcaucaauaagugauauggcaagugauagcagauguccaacacaaggagaagcuuaucuagauaaacaaagugauacacaauacguauguaaaagaacauuaguugacagaggauggggaaacggcuguggacuauuuggaaaaggaaguuuaguaacaugcgcaaaauucgcauguagcaaaaaaaugacaggaaaaaguauucaaccagaaaaccuagaauauagaauaauguuaagcguacauggaagucaacauucaggaaugauaguuaacgauacaggacaugaaacagaugaaaauagagcaaaaguagaaauaaccccaaauaguccuagagcagaagcagcauuaggaggauuuggaucacuaggauuagauugcgagccaagaacaggguuagauuuuucagauuuauauuaucuaacaaugaauaacaaacauugguuaguacacaaagaaugguuccacgauauaccauuaccauggcacgcaggcgcggacacaggaacaccccauuggaacaauaaagaagcauuaguagaauuuaaagaugcgcaugcaaaacgacaaacuguaguaguacuuggaagucaagaaggagcugugcauacagcucuggcaggagcuuuagaagcagaaauggauggagcaaaaggaagauuaucaaguggucacuuaaaauguagauuaaaaauggauaaacuaagguuaaaaggugugagcuacaguuuaugcacagcugcauuuacauuuaccaaaauaccugcagaaacacuacacggcacaguuacuguagaaguccaauaugcaggaacagacggaccauguaaagugccagcacaaauggcaguagacaugcaaacauuaacaccaguggggagacuaauaacagcaaauccaguaauaacagaaaguacagaaaauaguaaaaugauguuagaauuagauccaccauucggagauucauauauagucauaggugugggugaaaaaaaaauuacacaucauuggcauagaucaggaucaacgaucgguaaagcauuugaagcaacaguacguggggcgaaacgaauggcaguauuaggagauacggcaugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7137 - RNA, 1741 nt, Artificial Sequence
  KU729217.2 solE mRNA Design 2 opt
ggggcgcugccuacggagguggcagccaucuccuucucggcaucaagcuuaccaugucacaaaaaguaauauaucuaguaaugauauuauuaauagcaccggcauauagcauaagauguaucggaguaaguaauagagacuuuguagaaggaaugaguggaggaacauggguugauguaguacuagaacauggaggaugcgugacaguaauggcucaagauaaaccaacaguagauauagaacuaguaagcacaacaguaaguaauauggcagaaguuagaagcuauuguuacgaagcaacaauaagugauauugcaagugacaguagauguccaacacaaggagaagcauaucuagauaaacaaagugauacacaauauguauguaaaagaacgcuuguagauagaggauggggaaauggcuguggacuauuuggaaaaggaagccuaguaacaugugcaaaauucgcaugcaguaaaaaaaugacaggaaaaaguauacagccagaaaauuuagaauacagaauaaugcuaaguguacauggaucacaacacaguggaaugauaguaaacgauacaggacaugaaacagaugaaaacagagcaaaaguagaaauaacaccgaauagcccgagggcugaagcaacauuaggaggauuuggaagcuuaggauuagauugugaaccaagaacaggauuagauuuuagugacuuauacuauuuaacaaugaauaauaaacacugguuaguacauaaagaaugguuccaugacauaccccuaccuuggcaugcaggugcagauacaggaacaccacauuggaauaauaaagaagcauuaguagaauuuaaagaugcucaugcuaaaagacaaacagcaguuguacuaggaucacaagaaggagcaguacauacagcacucgcaggggcauuagaagcagaaauggacggagcaaaaggcagauuaucaagcgggcauuuaaaauguagacuaaaaauggauaaauuaagacuaaaaggugugucauauucacuauguacagcugcauucacauuuacaaaaauaccagcagaaacauuacacggaacggucacagucgaaguccaauacgcaggaacagauggaccauguaaaguacccgcacagauggcaguagauaugcaaacacuuacaccaguagguagauuaauaacagcaaauccaguaauaacagaaaguacagaaaacaguaaaaugaugcuagaauuagauccaccauuuggagauucauauauaguaauuggagugggcgaaaaaaaaauuacacaucacuggcaucgaaguggaucaacaauaggaaaagcauuugaagcaaccguaaggggagcuaaaaggauggcagucuuaggagacacagcuugggauuucgguucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7138 - RNA, 1741 nt, Artificial Sequence
  KY328290.1 solE mRNA Design 2 opt
ggggcgcugccuacggagguggcagccaucuccuucucggcaucaagcuuaccaugagucaaaaaguaauauaucuagugaugauauuauuaauagcaccagcauauagcauaagauguauaggagugucaaacagagauuucguagaaggaaugucaggaggaacauggguagaugugguacuagaacauggagguugcguuaccguaauggcacaagauaaaccaacaguagacauagaauuaguaacaaccaccguaaguaauauggcagaaguuagaaguuauuguuaugaagcaagcauaagcgacauggcaagcgacagcagauguccaacacaaggagaagcauauuuagauaaacaaagcgacacacaauauguaugcaaaagaacuuuaguagauagggguuggggaaauggcuguggacuauuuggaaaagguaguuuaguaacaugugcaaaauuugcauguucaaagaaaaugacuggaaaaucaauacaaccagaaaauuuagaauaucguauaaugcuaaguguacauggaucacaacacaguggaaugauaguaaaugauacaggacaugaaacagaugaaaauagagcaaaaguagaaauaacaccaaacucacccagagcugaagcaacguuaggaggauuuggaucauuaggauuagauugugaaccaaggacaggauuagauuuuagugaucuauauuaucuaacaaugaauaauaaacacugguuaguucauaaagaaugguuucaugauauaccauuaccauggcaugcaggagcagacacaggaacaccacauuggaacaauaaagaagcgcuaguggaauuuaaagaugcacacgcaaaaagacaaacuguaguuguacuaggaagucaagaaggggcaguacauacggcucuagcuggagcacuggaagcagaaauggacggggcuaaagguagauuaucgagcggacauuuaaaauguagguugaaaauggacaaacuuagauuaaaagguguaucauauaguuuauguacagcagcguuuacguuuaguaaaauaccugcagaaacauuacacggaacaguaacagaagaaguacaauacgcaggaacggauggucccugcaaaguuccagcacaaauggcuguggacaugcaaacauuaacaccuguaggaagauuaauaacagcaaacccaguaauaacagaaagcacagaaaauaguaaaaugauguuagaauuagauccaccauuuggagauaguuauaucguaauaggaguaggagaaaagaaaaucacucaucacuggcauagaagcgguaguacaauaggaaaagcauuugaagcaacaguaagaggagcaaaaagaauggcaguacuaggagauacagcgugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7139 - RNA, 1741 nt, Artificial Sequence
  KX087101.3 solE mRNA Design 2 opt
ggggcgcugccuacggagguggcagccaucuccuucucggcaucaagcuuaccaugucacaaaaaguaauuuauuuaguuaugauauuacuaauagcaccagcauauucaauaagauguauaggagugaguaaucgagauuuuguagaaggcaugaguggaggaacuuggguagauguaguuuuagaacacggcggaugcguaacaguaauggcacaagauaaaccgacgguagacauagaauuaguaacaacaacaguuaguaacauggcagaaguaagaucauauuguuaugaagcaaguauaagugauauggcuagugauucaagauguccaacacaaggcgaagcauacuuagauaaacaaagcgauacacaauauguauguaagagaacauuaguagauagagguuggggaaauggauguggauuauuuggaaaaggaucacuaguaaccugcgcaaaauuugcuuguucaaaaaaaaugacaggaaaaucaauccaaccagaaaaucuagaauauagaauaauguuaucaguacaugggagccaacacucgggaaugauaguaaaugauacuggccacgaaacagacgaaaaucgagcaaaaguagaaauaacaccaaauucaccaagagcagaagcaacacuaggaggauuuggaucauuaggauuagacugugaaccaagaacuggacuagauuuuucagaccuauacuaucuaacaaugaauaauaaacacugguuaguacauaaagaaugguuucaugacauaccacugccauggcaugcaggcgcagauacgggaacgccacauuggaacaauaaagaagcauuaguugaauuuaaagaugcacaugcgaaaagacaaacuguaguaguauuaggaagccaagaaggagcaguucacaccgcauuagcuggagcguuagaagcagaaauggacggagcaaaagggagauuaucaagcggucaucuaaaaugcagacuaaaaauggauaaauuaagauuaaaaggaguaagcuauucgcuauguacagcagcauuuacauuuacaaaaauaccagcagaaacauuacauggaacaguaacaguagaauuacaauaugcuggcacagauggaccauguaaaguaccagcacaaauggcaguagauaugcaaacucuuacaccaguaggacgauuaauuacagcaaauccaguaauaacugaaucuacugaaaacaguaaaaugauguuagaauuagauccaccauuuggagauaguuauauaguaauaggaguaggagaaaaaaaaauaacacaucauuggcauagaucagguaguacaauaggaaaagcauuugaagcaacaguaagaggagcaaaaagaauggcaguuuuaggugauacagccugggauuuugguucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7140 - RNA, 1741 nt, Artificial Sequence
  KY003156.1 solE mRNA Design 2 opt
ggggcgcugccuacggagguggcagccaucuccuucucggcaucaagcuuaccaugagucaaaaagugaucuauuuaguaaugauucuacuaauagcaccagcauauucaauaagauguauaggcauaucuaacagggauuuuguugaaggaaugaguggaggaacuuggguagacguaguauuggaacauggaggauguguaacaguaauggcacaagauaaaccuacaguagacauagaacugguaacaacaacaguaaguaauauggcugaaguaaggucauacuguuacgaagcaaguauaagcgauauggcaagugauucaagaugcccaacacaaggagaagcauaucucgauaaacaaagcgauacacaauauguauguaaaagaacauuaguagauagaggauggggaaacgguugcggauuauuugggaaaggaucuuuaguaacaugugcaaaauucgcauguaguaaaaaaaugacaggaaaauccauacaaccagaaaacuuagaauauagaauaauguuaaguguacacgguagucaacauucaggaaugauuguaaaugauacaggacacgaaaccgacgaaaauagagcaaaaguagaaauaacaccaaacucaccaagagcagaagcaacacuaggaggauuuggaauacuuggauuagauugugaaccacgaacuggacuagauuuuucagaccuauauuaucuaacgaugaauaauaaacauuggcuaguacauaaagaaugguuucaugauauacccuuaccauggcaugcaggcgcagauacgggaacgccacauuggaacaacaaagaagcauuaguagaauuuaaagaugcacaugcaaaacgacaaacaguaguaguauuagggucacaagaaggagcaguacauacugcacuugcaggagcuuuagaagcagaaauggacggugcaaaaggaagauuaucaucaggacacuuaaaauguagauuaaaaauggacaaauuacgauuaaaaggaguaucauauagcuuaugcaccgcagcauuuacauuuacuaaaauaccugcugaaacauuacauggaaccguaacaguagaaguacaauaugcaggaacagauggaccauguaaaguaccagcacaaauggcaguagauaugcaaacacuaacaccaguaggaagacuuaucacagcaaauccaguaauaacagaaagcacggagaauucaaaaaugauguuagaacuagauccaccauuuggagacucauacauaguaauaggaguaggagaaaaaaaaauaacacaucauuggcacagaucaggaaguacuauaggaaaagcauuugaagcaacgguaagaggagcaaagagaauggcaguauuaggagauacagcaugggauuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7141 - RNA, 1741 nt, Artificial Sequence
  KU758876.1 solE mRNA Design 2 opt
ggggcgcugccuacggagguggcagccaucuccuucucggcaucaagcuuaccaugucacaaaaaguaauauauuuaguaaugauauuauuaauagcaccagcauauaguauaagauguauaggaguaaguaauagagauuucguagaaggaaugagugggggaacauggguagauguaguauuagaacauggaggguguguaacaguaauggcacaagacaaaccaaccguggauauugaauuaguaacuacuacagucaguaauauggcagaagucagaucauauuguuacgaagcuaguauaucagacauggcgagugauagcagauguccaacacaaggagaagcauauuuagauaaacaaagugauacucaauauguauguaaaagaacauuaguugauagaggguggggaaauggauguggauuauuuggaaaaggaagcuuaguaacaugugcaaaauucgcauguaguaaaaaaaugacaggaaaaaguauacaaccagaaaacuuagaauauagaauaaugcugaguguacauggaucacaacauucaggaaugauaguaaaugauacaggacaugagacagaugaaaacagagcaaagguagaaauaacuccaaacaguccacgagcagaagcaacacuagguggauuuggaucacuaggacuagauugugaaccuagaacaggauuagauuuuucagauuuauauuaucuuacaaugaacaacaaacauuggcuaguacauaaagaaugguuccacgauauaccacuaccauggcaugcuggagccgauaccggcacuccacauuggaacaauaaagaagcauuaguagaauucaaagaugcacacgcuaaaagacagacagugguaguauuaggaagucaagaaggagcaguacacacagcacuagcaggagccuuagaagcagaaauggaugggguaaaagguagguuaagcaguggacacuuaaaauguagauuaaaaauggauaaacuaagacuuaaagguguaaguuacucauuauguacagcagcuuuuacguuuacuaaaaucccugcagaaacacuacauggaacaguaaccguggaaguacaauacgcaggaacagauggaccauguaaaguaccagcacaaauggcuguagauaugcaaacauuaaccccaguaggaagauugauaacagcaaauccaguaauaacagaaaguacagaaaauaguaaaaugauguuagaauuagauccucccuuuggugauagcuauauaguuauagguguaggagaaaaaaaaauaacacaucauuggcacagaucaggcagcacaauagguaaagcuuuugaagcaacaguaagaggagcaaaacgaauggcaguguugggagauacagccugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7142 - RNA, 1741 nt, Artificial Sequence
  KU926310.1 solE mRNA Design 2 opt
ggggcgcugccuacggagguggcagccaucuccuucucggcaucaagcuuaccaugagccaaaaaguaauuuauuuaguaaugauacuauuaauagcaccagcauauaguauaagauguauagggguauccaacagagauuucguugaaggaaugagcggaggaacauggguagauguaguuuuagaacaugguggauguguaacaguaauggcacaagauaaaccuacaguagauauagaauuaguaacaacaacaguaucaaacauggcagaaguaagaaguuauugcuaugaagcaagcauuagugauauggcaagugauagucgauguccaacacaaggagaagcauaucuagacaaacaaagugacacacaauacguauguaaaagaacauuaguagauagaggaugggguaauggcugcggacuauucgggaaaggauccuuaguaacuugugcaaaauuugccuguaguaaaaaaaugacaggaaaaucaauacaacccgaaaaucuagaauaccgaauaaugcuaaguguacacggaagucaacauucaggaaugaucgugaaugacacagggcaugaaacugaugaaaacagagcaaaaguagaaauuacaccaaauucaccaagggcugaagcaacauuaggaggauucggaaguuuaggacuggauugugaacccagaacuggauuagacuuuucagauuuauacuauuuaacaaugaauaacaaacacuggcuaguacauaaagaaugguuucacgauauaccauuaccauggcaugcaggagcagauacaggaacaccacauuggaauaauaaagaagcacuaguagaauuuaaagaugcacacgcuaaaagacaaaccguuguaguauuaggaucacaagaaggagcgguucacacagcacuagccggagcauuagaagcggaaauggauggagcaaaaggaagauuaucaucaggucacuuaaaauguagguuaaaaauggauaaacuaagacuaaaaggaguaagcuauagucuuuguacagcagcauucacauucacaaaaauaccagcagaaacauuacauggaacaguaacaguugaaguacaauaugcaggagcagacggaccaugcaaaguaccugcacaaauggcaguggauaugcaaacauuaacuccaguagguagguuaauaacagcaaacccaguaauaacagaaaguacggaaaauucaaaaaugaugcuagaauuagauccaccauuuggagauaguuauauaguaauaggaguaggagaaaaaaaaauuacacaccauuggcauagaucagguaguacaauaggaaaagcauuugaagcaaccguacguggagcuaaaagaauggcuguauuaggagauacagcaugggacuuugguaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7143 - RNA, 1741 nt, Artificial Sequence
  KU681081.3 solE mRNA Design 2 opt
ggggcgcugccuacggagguggcagccaucuccuucucggcaucaagcuuaccaugucacaaaaaguaauauaucuaguuaugauacuauuaauagcaccagccuacaguauacgauguauuggaguaaguaauagagauuuuguugaaggaaugagugggggaacauggguagaugugguacuugaacauggaggaugugucacaguaauggcacaagauaaaccaacaguggauauagaauuaguaacaacuacaguaaguaacauggcagaaguaagaaguuauugcuacgaagcuucaauaagugacauggcaagugauagcagauguccgacacaaggcgaagcauaucuagauaaacaaagcgauacucaauauguauguaaaagaacauuaguagacagagguuggggcaauggauguggauuauuugguaaaggcucucuaguaacaugugcaaaauuugcauguucaaaaaaaaugacaggaaaaucaauucaaccagaaaaucuagaauauagaauaauguuaucaguccauggaagucaacauucagguaugauaguaaacgacacaggacaugaaacagaugaaaacagagcaaaaguagaaaucacaccaaauaguccaagagccgaagcaacuuuaggaggauucggaucauuaggauuagauugcgaaccaagaaccggguuagauuuuagugauuuauauuaucuuacuaugaauaauaaacauuggcuaguacauaaagaaugguuucaugauauaccauuaccuuggcacacuggagcagauacaggaacaccacauuggaacaauaaagaagcuuuaguagaauuuaaagaugcacaugcaaaaagacaaacaguaguaguauuaggaagucaagaaggagcuguacauacugcauuagcuggugcauuagaagcagaaauggauggagcaaaaggaaggcuaagcaguggacaucuaaaauguagauuaaaaauggauaaacuaagauuaaaaggaguaucauauagucuauguacagcagcauucacauuuacaaagauaccagcagaaacacuacacgguacaguaacgguagaaguccaauaugcaggaacagauggcccuuguaaagugccagcacaaauggcaguagauaugcaaacacuaacuccaguaggaagacuuauaacagcaaauccaguuauaacagaaggcacagaaaacaguaaaaugauguuagaacucgauccaccauuuggcgauucauauauaguaauaggaguaggagaaaaaaaaauaacacaucauuggcauaggucuggaucaacuauaggaaaagcauuugaggcaacuguaagaggagcaaaaagaauggcaguuuuaggugauacagcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7144 - RNA, 1741 nt, Artificial Sequence
  KU744693.1 solE mRNA Design 2 opt
ggggcgcugccuacggagguggcagccaucuccuucucggcaucaagcuuaccaugucacaaaaaguaauauauuuaguaaugauauuguuaauagcaccagcguacaguauuagauguauaggaguuagcaauagagauuuuguagaaggaaugaguggaggaaccuggguagauguaguauuagaacaugggggauguguaacagcaauggcgcaagauaaaccaacaguagacauagaauuaguaacaacuaccguuaguaauauggcagaaguacgaagcuauuguuacgaagcuucaauaagugauauggcaagugacagcagauguccaacacaaggagaagcguaccuagauaaacaaagugauacacaauacguaugcaaaaggacuuuaguagauagaggauggggaaauggaugugguuuauuugggaaaggaagccuuguaacaugugcaaaauuugcauguagcaaaaaaaugacagguaaaucaauacaaccugaaaaucuagaauauagaauaauguuaagcguacauggaucacaacauagcggaauguuaguaaacgauacaggacaugaaacagaugaaaauagagcaaaaguagaaauaacgccaaacucaccucgagccgaagcaacauuagguggauuuggaucauuaggauuagauugcgaaccaagaacaggcuuagacuuuagcgauuuauauuacuuaacgaugaacaauaaacauugguuagcucauaaagaaugguuucaugauauaccacuaccauggcacgcgggagcagcaacaggaacgccucauuggaauaauaaagaagcauuaguagaauuuaaagaugcacaugcuaaaagacaaacaguaguaguacuaggaagccaagaaggagcaguacacacagcauuggcaggagcauuggaagcagaaauggauggagcaaaaggacgauuaaguucuggacauuuaaaaugucgauuaaaaauggauaaacuaagacucaaagggguaucauacucauuauguacagcagcguuuacauucacaaaaauaccagcagaaacaguagaugguacaguaacaguagaaggacaauaugguggaacagacggaccaugcaaagugccagcacaaauggcaguagauaugcaaacacuuacaccaguaggaagauuaauaacagcaaauccagugauaacagaaucgacagaaaacaguaaaaugauguuagaacuagauccaccuuuuggagauucauauauuguaauaggaguaggggaaaaaaaaauaacacaucauuggcauagaucuggaagcacgauaggaaaagcuuuugaagcaacaguaagaggagcaaaaagaauggcaguuuuaggggauacagcaugggauuucggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7145 - RNA, 1741 nt, Artificial Sequence
  EU545988.1 solE mRNA Design 2 opt
ggggcgcugccuacggagguggcagccaucuccuucucggcaucaagcuuaccaugagccaaaaaguuauauaccuaguaaugauauuauuaauagcaccagccuauaguauacgaugcauuggaguaucaaauagagauuucguagaaggcaugucagguggaacauggguagauguaguauuagaacauggaggauguguaacaguaauggcacaagacaaaccagcaguagauauagagcuaguaacaacuacaguaucaaauauggcagaaguaagaaguuacuguuaugaagcuagcauaagcgauauggcaucugauucuagguguccaacacaaggcgaagcauauuuagauaaacaaucugauacacaauacgucuguaaaagaacucuaguagauagaggauggggaaacggaugugguuuauucggaaaaggcagcuuaguuacaugugcaaaauuugcaugcucaaagaaaaugacaggaaaaucaauacaaccugaaaaccuagaauacagaauaauguuaucagugcacggaucacaacauagcggaaugauagucaaugauacaggacaugaaacagaugaaaacagagcuaaagucgaaauaacaccaaacaguccaagagcugaagcaacauuaggaggauucgguagcuuaggacuugauugcgaaccaagaacaggacuagauuuuucagaucuuuauuacuuaaccaugaacaacaaacauugguugguacacaaagaaugguuucaugauauaccacuaccuuggcaugcaggagcagauacuggaacaccacauuggaacaauaaagaagcauuaguagaauuuaaagacgcucaugcaaaaagacaaacagucguuguauuaggaucacaagaaggagcaguacauaccgcucuagcuggagcauuagaagcagaaauggauggagcaaaaggaagauuaucaucaggacacuuaaaaugcagacuaaaaauggacaaauuaagacucaaaggaguaucuuauucauuaugcaccgcagcauuuacauuuacaaaaauaccagcagaaacacuacauggaacuguaacagucgaaguccaauaugcaggaacagauggaccgugcaaagucccggcacaaauggcaguagacaugcaaacuuuaacaccaguaggacgauuaauaacugcaaauccuguaauaacagaaagcacagaaaauucaaaaaugaugcuagaauuagauccacccuucggagauucauauaucguaauaggaguaggagaaaagaaaauaacacaucauuggcauagaucaggaagcacuauagguaaagcauuugaagcaacaguaagaggugcaaaaagaauggccguuuuaggugauacagcaugggauuuuggcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7146 - RNA, 1741 nt, Artificial Sequence
  KY007221.1 solE mRNA Design 2 opt
ggggcgcugccuacggagguggcagccaucuccuucucggcaucaagcuuaccaugagucaaaaaguaauauauuuagugaugauacuauuaauagcaccagcauauaguauaagauguauaggugugaauaauagagauuuuguugaaggaaugucagggggaacauggguagaugucgucuuagaacacggagguuguguaacagugauggcacaagauaaaccaacaguagauauagaauuaguaacaaccacaguaaguaauauggcagaaguaagaucauauuguuaugaggcaaguauaagugauauggcaagugauaguagauguccgacacagggagaagcauauuuagauaaacaaagcgauacucaauauguauguaaaagaacauuaguagauagaggauggggaaauggaugcggauuguuuggaaaaggaagucuagugacaugugcaaaauuugcaugcuccaaaaaaaugacaggaaaaucaauacaaccagagaacuuagaauauagaauaauguuaaguguacauggaagucaacacagcggaaugauaguuaaugauacaggacaugaaacagaugaaaaucgagcgaaaguugaaauaacuccaaacucaccuagagcagaagcaacauuaggaggguucggaucauuaggacuagauugugaaccaagaacaggacuagauuucagugacuuauauuaucuaacaaugaauaauaaacauuggcuaguacauaaagaaugguuucaugauauacccuuaccauggcaugcgggugcagauacagguacaccacauuggaauaauaaagaagcccuuguggaauuuaaagaugcacacgcaaaaagacaaacaguagucguacuagguucacaagaaggagccgugcacacagccuuagcaggagcacuggaagcagaaauggauggggcaaaaggaagauuaucgaguggacaucuaaaaugcagacuaaaaauggauaaauuaagauuaaaaggaguaaguuauucauuauguacagcagcauuuacauuuacaaaaauaccagcagaaacauuacauggaacaguaacaguugaaguacaauaugcgggaacagacggaccauguaaaguaccagcacaaauggcaguagacaugcaaaccuuaaccccagucggaagacuaauaacagcaaacccgguaauaaccgaaaguacagaaaacucuaaaaugauguuagaacuagauccaccauuuggagauaguuacauaguaauaggagugggagaaaagaaaauaacacaucacuggcauagaagcggaagcacaauuggcaaagcauucgaagcaaccguaagaggagcaaaaagaauggcaguauuaggagauacugcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7147 - RNA, 1741 nt, Artificial Sequence
  KY003152.1 solE mRNA Design 2 opt
ggggcgcugccuacggagguggcagccaucuccuucucggcaucaagcuuaccaugucacaaaaaguaauauauuuagucaugauauugcuaauagcaccugcauauaguauaagauguauaggaguaaguaauagagacuuuguagaaggaaugagcggcggaacauggguagacguaguacuagaacauggaggauguguaacaguaauggcacaagauaaaccaacaguagauauagaauuaguaacaacaacaguaucuaacauggcugaaguaagaaguuauugcuacgaagcaaguauaagcgauauggcaucagauuccagauguccgacacaaggagaagcauauuuagauaaacaaagcgauacacaauaugugugcaaaagaacauuaguagauagaggauggggaaauggaugcggacuauuuggaaaagguagcuuaguaacaugugcaaaauuugcauguucuaaaaaaaugacaggaaaaagcauacaaccagaaaauuuagaauaucgaauaauguuaagcguacauggaucacagcauucaggaaugauaguaaacgauacaggucaugaaacagacgaaaauagagcaaaaguagaaauaacaccuaacuccccaagagcagaagcaacauuaggaggauuuggaucacuaggauuagauugugaaccaagaacuggacuugacuucagugacuuauauuauuuaacaaugaauaauaaacauugguuaguacauaaagaaugguuucacgacauaccauuaccauggcaugcaggagcagauacaggaacuccccauuggaauaauaaagaagcauuaguagaauuuaaagaugcacacgcaaaaagacaaacaguaguaguacuuggaagucaagaaggagcaguacauacagcuuuagcaggagcacuggaagcagaaauggacggugcuaaaggaagacuuucaaguggacaucuaaaaugucgguuaaaaauggauaaauuaagauuaaaaggcguaaguuauagcuuaugugcagcagcauuuacuuuuacaaaaauaccugcagaaacacuacacgguacaguuacgguagaaguccaauaugcuggaacggauggaccauguaaaguaccugcacaaauggcaguagauaugcagacauuaacuccagugggaagauuaaucacagcaaauccaguaauaacagaaaguacagaaaauaguaaaaugaugcuagaauuagauccaccauucggggauaguuauauaguaauaggaguaggugaaaaaaaaauaacacaucacuggcauagauccggaucgacaauaggaaaagcauuugaagcaacaguaagaggggcuaaaagaauggcaguauuaggagauacagcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7148 - RNA, 1741 nt, Artificial Sequence
  KX694533.2 solE mRNA Design 2 opt
ggggcgcugccuacggagguggcagccaucuccuucucggcaucaagcuuaccaugucacaaaaaguaauauaccuaguaaugauauuauuaauagcaccagcauauagcauaagauguauaggaguaaguaauagagacuuugucgaaggaaugaguggaggaacauggguagacguaguauuagaacauggaggauguguaacaguuauggcacaagauaaaccaacaguagacauagaacuaguaacaacuacaguuucaaauauggcugaaguaagaaguuauuguuacgaagcaaguauuagcgauauggcgagugauucaagaugcccaacucaaggagaagcauaucuagauaaacaaagugauacacaauauguauguaaaagaacacuaguagacagaggauggggaaauggauguggauuauuuggaaaaggaucauuaguuacaugugcaaaauuugcauguucaaaaaaaaugacaggaaaaaguauacaaccugaaaauuuggaauauagaauaaugcugaguguacauggaucacaacacaguggaaugauagucaaugauauuggacaugaaacagaugaaaaucgagcaaaaguagaaauaacaccgaauagcccaagagcagaagcaacuuuaggaggauuuggaucauuagggcuagauugugaaccuagaacuggacuagauuuuagugacuuguauuacuuaacaaugaauaacaaacacuggcugguacauaaagaaugguuucaugauauaccauuaccauggcacgcaggugcagacacaggaacaccacauuggaauaauaaagaagcauuaguagaauucaaagaugcacaugcaaaaagacaaacagugguaguauuaggaagucaagaaggagcaguacauacugcauuagcaggugcuuuagaagcagaaauggauggagcaaaaggaagauuaucuucaggacauuuaaaaugcagauuaaaaauggacaaauuaagguuaaaaggaguaaguuacagccuuuguacagcagcauuuacuuuuacgaaaauccccgcagaaacuuuacauggaacaguaacaguagaaguacaauaugcaggaacagacggaccaugcaaaguaccagcacaaauggcagucgauaugcaaacauuaacaccuguaggaagacucauaacagcgaauccgguuauuacugaaucaacagaaaauaguaaaaugaugcuagaauuagacccaccauuuggagauucguauauaguaauaggaguaggcgauaaaaaaauaacacaucauuggcauagaucaggaucaacaauaggaaaagcauuugaagcaacaguaagaggagcaaaaagaauggcaguauuaggagauacagcaugggacuuuggaucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7149 - RNA, 1741 nt, Artificial Sequence
  KX601167.1 solE mRNA Design 2 opt
ggggcgcugccuacggagguggcagccaucuccuucucggcaucaagcuuaccaugucgcaaaaaguaauauauuuaguaaugauucuauuaauagcuccugcauauucaauaagauguauagguguaagcaauagagauuuuguagaaggaaugaguggaggaacguggguagauguaguauuagaacacggaggauguguaacuguaauggcacaagauaaaccaacuguagauauagaauuaguaacaacuacaguaucaaauauggccgaaguaagaagcuauugcuaugaagcuaguauaagugacauggcaucagacucaagauguccaacacaaggcgaagcauaccuagauaaacaaagugauacacaauaugucugcaaaaggacgcuaguagauagaggauggggaaauggauguggucuauuuggaaaagggucauuagucacaugugcaaaauuugcauguucaaagaaaaugacaggaaaaucaauacagccagaaaauuuagaauauagaauuauguuaaguguacacggaagccaacacucaggaaugauuguaaacgacacaggacaugaaaccgaugaaaacagagcaaaaguagaaauaacaccuaauucaccaagagcagaagcaacguuaggaggauuugguucuuuaggacuagauugugaaccaaggacaggacuagauuuuagugacuuauauuacuuaacaaugaacaauaaacauuggcuaguucauaaagaaugguuucaugauauaccucuaccauggcacgccggagcagauacuggaaccccacauuggaauaauaaagaagcauuaguagaauuuaaagaugcacacgcaaaaagacaaacuguaguaguauuagguucucaagaaggugcaguacacacagcuuuagcaggagcauuagaagcagaaauggauggugcaaaaggaagacuaaguaguggacacuuaaaauguagauuaaaaauggauaaacuaagauuaaaaggaguaucauauucauuauguacugcagcauucacauucacaaaaauuccagcagaaacuuuacauggaacaguuacaguugaaguacaauaugcaggaacagauggaccaugcaaaguaccagcgcaaauggcaguagauaugcaaacauuaacuccaguaggacgauuaauaaccgcaaauccaguaauaacagaaaguacagaaaacaguaaaaugaugcuugaauuagacccaccauuuggagauucauauauuguaauagguguaggagacaagaaaauaacacaccacugguacagaucgggaucaacgauaggaaaagcauuugaagcaacaguaagaggagcaaaaagaauggcaguauuaggagacacagcaugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7150 - RNA, 1741 nt, Artificial Sequence
  KY288905.1 solE mRNA Design 2 opt
ggggcgcugccuacggagguggcagccaucuccuucucggcaucaagcuuaccaugucacaaaaagugauauauuuaguaaugauauuacuaauagcaccagcauacaguauaagauguauaggaguaucuaauagagauuuuguagaaggaaugucaggaggaacauggguagauguaguacuagaacacggaggauguguaacaguaauggcacaagacaaaccaacaguagauauagaauuaguaacaacaacuguaagcaacauggcagaaguuagaaguuauuguuaugaagcaaguauaagugauauggcaagugauucaagauguccuacacaaggagaagcauacuuagacaaacaaagcgauacacaauauguuugcaaaagaacguuagucgaccgaggaugggggaacggauguggacuauuuggaaaaggaagucuaguaacaugugcuaaauuuacauguagcaaaaaaaugacaggaaaaucaauacaaccagaaaauuuagaauacagaauaauguuaagugugcauggaucacaacauagcggaaugauaguuaaugauacugggcacgaaacugaugaaaauagagcgaaaguagaagucacaccaaacaguccaagagcggaagcaacuuuaggaggauucgguucauuaggacuagauugcgaaccuaggacuggauuagauuuuucagaucuauauuaucuuacaaugaauaauaaacauugguuaguacauaaagaaugguuucaugauauaccacuaccguggcaugcaggagcagauacaggaacaccucauuggaauaacaaagaagcauuaguagaauucaaagaugcacaugcaaaacgacaaacgguaguaguacuuggaagucaagaaggagcaguacacacagcauuagcaggagcuuuagaagccgagauggacggggcaaaaggcagacuauuuagcggacacuuaaaaugcagauuaaaaauggauaaauuaagauuaaagggaguaaguuauucauuauguacagcugcauuuacuuuuacaaaaguuccagcagagacauuacauggaacaguaacaguggaaguacaauaugcaggaacagaugggccauguaaaguuccagcacaaauggcaguagauaugcaaacauuaacuccaguaggaagacuuauuacagcaaauccaguaauaacagaaaguacagaaaauaguaaaaugaugcuugaauuagacccaccauuuggggauucuuauauagucauaggaguuggagauaaaaaaauaacucaucauuggcauagaucuggcucaacuauaggaaaagcguuugaagcaacgguaagaggagcaaaaagaauggcuguacuaggcgacacagcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7151 - RNA, 1741 nt, Artificial Sequence
  KF268950.1 solE mRNA Design 2 opt
ggggcgcugccuacggagguggcagccaucuccuucucggcaucaagcuuaccaugucacaaaaaguuauauauuuaguaaugauauuguuaauagcaccggcauauaguauaagauguauaggaguaucaaauagagauuuugucgaaggaaugaguggaggaacauggguugauguaguauuagaacauggcggaugcguaacuguaauggcacaagauaaaccaacuguggauauagaauuaguaacaacaacaguaagcaauauggcagaaguaagaaguuauuguuaugaagcaucaauaagugauauggcaagugauucucgaugcccgacacaaggagaagcauacuuagauaaacaaagugauacacaauauguaugcaagcgaacacuuguagacagaggauggggaaacggaugugguuuauucgguaaaggaaguuuaguaacuugugcaaaauuuacauguagcaaaaaaaugacaggaaaaucaauacaaccugagaauuuagaauauagaauuaugcuaagcguacacgggucacaacauagcggaaugauaguaaaugauauaggacaugaaacagaugaaaauagagcaaaaguagaaguaacuccaaauaguccaagagcagaagcaacauuagggggcuucgguucauuagguuuagacugcgaaccacggacuggacuagacuucucagauuuauauuauuuaacaaugaauaacaaacacuggcugguacauaaagaaugguuucacgauauaccuuuaccauggcaugcgggcgcagauacaggaacaccucauuggaauaacaaagaagcacuaguagaauuuaaagaugcacaugcaaaacgacaaacaguaguaguauuaggaagucaagaaggggcaguacauacagcacuagcgggagcauuagaggcagaaauggauggagcaaaaggaagguuauucagcggacauuuaaaauguagacuuaaaauggauaaauuaagauuaaaaggaguaagcuauaguuuauguacagcagcauuuacauuuacaaaaguaccagcagaaacauuacauggcacaguaaccguagaaguacaauaugcaggaacagauggaccaugcaaaguaccagcucaaauggcuguagauaugcaaacacuaacaccuguaggaagacugauuacagcuaauccagucauaacagaaaguacggaaaauagcaaaaugauguuagaacuagauccaccauuuggggauagcuacauaguaauaggaguaggagauaaaaaaauaacacaucacuggcauagaucaggaucaacaauaggaaaagcauuugaagcaacaguaagaggagcaaaacgcauggcaguauuaggggacacagcuugggauuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7152 - RNA, 1741 nt, Artificial Sequence
  KF383116.1 solE mRNA Design 2 opt
ggggcgcugccuacggagguggcagccaucuccuucucggcaucaagcuuaccaugagucaaaaaguuauauauuuaguuaugauauuacuaauagcaccagcauauucaauaagauguauaggaguaagcaacagagauuuuguugaaggaaugagcgguggaacauggguagacguaguauuagaacauggaggauguguaacaguaauggcacaagauaaaccaacaguagacauagaacuaguaacaacaacaguuucaaauauggcagaaguaagaaguuauugcuaugaagcaaguauaagugacauggcaagugauaguagauguccaacucaaggugaagcauacuuagauaaacagagugacacacaauacguauguaaacgaacucuaguagacagaggcuggggaaauggaugugggcuuuucggaaaaggaucauuaguuacgugugcaaaauuuacaugcaguaaaaaaaugacaggaaaaucaauacaaccagaaaaucuggaauauagaauaauguuaagcguacauggaagucaacauucaggaaugauaguaaacgauaucggacaugaaacagaugaaaacagagcaaaaguagaaguaacuccaaauagcccaagagcagaagcaacauuaggaggauuuggaucauuaggucuagauugugaaccaagaacaggacuagauuuuagugaucuauacuaucuaacaaugaauaauaaacauugguuaguacacaaagaaugguuccaugauauaccauuacccuggcaugcaggagcagacacaggaacaccacauuggaacaauaaagaagcauuaguagaauuuaaagacgcacaugcaaaaagacaaacuguaguagugcuaggaagucaagaaggagcuguacacacagcacuagcaggugcauuagaggcagagauggauggagcaaaaggaagauuauuuaguggacaucuaaaguguagacuaaaaauggacaaauuaagauuaaaaggaguaaguuauagucugugcacagcuguaugcacagcagcaaaaguaccagcagaaacuuuacauggaacaguaacuguagaaguacaauaugcagggacagaugguccuuguaaaguaccagcucaaauggcaguagacaugcaaacgcuaacaccaguaggaagacuaaucacagcaaauccaguuauaaccgaaaguacagaaaauagcaaaaugauguuagaacucgauccuccauuuggagauagcuauaucguaauaggaguaggagacaaaaaaauaacucaucauuggcauagaaguggaucaacaauaggaaaagcauuugaagcaacaguaagaggugcaaaaagaauggcaguacuaggagacacagcaugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7153 - RNA, 1723 nt, Artificial Sequence
  KU963574.2 solE mRNA Design 2 opt
ggggcgcugccuacggagguggcagccaucuccuucucggcaucaagcuuaccaugucacaaaaaguaauauacuuaguuaugauauuacuaauagcaccggcuuauaguauaagaugcauaggaguaagcaauagagauuuuguagaaggaaugagcggaggaacauggguagauguaguauuagaacacggaggcugcguaacaguaauggcucaagauaaaccaacuguagauauagaacuaguaacaacuacaguaucaaauauggcagagguaagaaguuauuguuaugaagcaucaauaagcgauauggcaucagacaguagauguccaacacaaggugaagcauauuuagauaaacaaagugauacacaauauguauguaaaagaacccuaguagacaggggauggggaaauggcuguggauuauuuggaaaaggaucacuaguuacaugugcaaaauucacauguagcaaaaaaaugacaggaaaaucaauacaaccagaaaacuuagaauacagaauaauguuaaguguacacggaagccaacauucagguaugauaguaaaugaugaaaacagagcaaaaguagaaguuacaccaaauucaccaagagcagaagcaacacuaggaggauuugguucucuuggauuagauugugagccaagaacaggucuggauuuuagugacuuauauuacuuaacaaugaauaauaaacauugguuaguucacaaagaaugguuccaugauauucccuuaccauggcauucaggagcagauacagaaacaccacauuggaauaauaaagaagcauuaguagaauuuaaagaugcacaugcaaaaagacaaacaguuguuguacugggaagccaagaaggggcaguacauacagcauuagcuggagcacuagaagccgaaauggauggagcgaaaggcagacuaucaaguggacauuuaaaauguagauuaaaaauggauaaauuaagauuaaaaggaguaagcuacucauuauguacagcagcauucacauuuacaaaaguaccagcagaaacauuacaugguacaguaacaguagaaguccaauaugcuggaagagauggaccauguaaaguaccagcacaaauggcaguagauaugcaaacauuaacaccaguugguagauuaauaacagcuaauccagugauaacugaaucaacagaaaauaguaagaugauguuagaacuagauccaccauucggagacaguuauauaguaauaggagucggagauaaaaaaauaacgcaucauuggcauagaagcggaaguauuauaggaaaagcauucgaagcaacaguaagaggagcaaaaagaauggcgguacuaggagauacagcuugggauuuugguaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7154 - RNA, 1741 nt, Artificial Sequence
  KF383118.1 solE mRNA Design 2 opt
ggggcgcugccuacggagguggcagccaucuccuucucggcaucaagcuuaccaugucgcaaaaaguaauauaucucguuaugauaguucuaauaguaccagcuuacaguauaagcuguauaggaguaucaaauagagacuuaguggaaggcaugagcggagguacauggguagacguaguauuagaacacggaggaugcguaacagaaauggcccaagauaaaccaacuguggauauagaauuaguaacgaugacaguaagcaauauggcugagguaagaagcuauuguuacgaagcaaguuuaucagauauggcuagcgcaucaagguguccaacacaaggcgaaccaucauuagauaaacaaagugauacucaaaguguauguaaaagaacucuaggagauaggggauggggaaauggaugcggaauauucgguaaaggaagucuaguaacaugcaguaaauucacauguuguaaaaaaaugccuggaaaaucaauucaaccagaaaauuuagaauacagaauaaugcuaccaguacauggaagucaacauagcggaaugauaguuaaugauauaggacaugaaacugaugaaaacagagcaaaaguagaaguaacuccaaacagcccuagagcagaagcaacacucggaggauucggaucacucggauuagauugugaaccaagaacaggacuugacuucagugaucuuuacuauuuaacgaugaauaacaaacauugguuaguacauaaagaaugguuccaugauauaccauuaccauggcaugcaggagcagauacaggaacaccacauuggaacaauaaagaagcguuaguagaauuuaaagaugcacaugcaaaaagacaaacaguaguaguauuaggaagccaagaaggagcuguacacacggcacuagcaggggcauuagaagcagaaauggauggagccaaagguagauuauuuaguggacauuuaaaauguagauuaaaaauggauaaacuaagacuaaaaggaguaaguuacagcuuauguacagcagcauuuacauucacaaagguaccagccgaaaccuuacacggaacaguuacaguagaaguccaaagugcaggcacagaugguccauguaaaguaccggcacaaauggcaguagauaugcaaacuuuaacaccuguaggaagguuaauaacagcaaauccaguaauaacagaaagcacagaaaauaguaaaaugaugcuagaauuagacccaccauuuggagauucauauauaguaauaggagucggagauaaaaaaauaacacaucauuggcacagaaguggaucaacaauaggaaaagcauuugaagcaacaguaagaggcgccaaaagaauggcaguauuaggagauacagcaugggauuuuggaucuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7155 - RNA, 1741 nt, Artificial Sequence
  KX520666.1 solE mRNA Design 2 opt
ggggcgcugccuacggagguggcagccaucuccuucucggcaucaagcuuaccaugagacaaaaaguaauauauuuaguaaugauauuacuaauugcaccugcauauucaauaagaugcauagguguuaguaauagagauuuuguugaaggaaugucaggaggaacuuggguagacguaguacuagaacaugguggcuguguaacaguaauggcacaagauaaaccaacaguagauauagagcuaguuacgacaacaguuagcaacauggcagagguaagaaguuauuguuaugaagcaaguauaucagacauggcaagcgauucaagguguccaacacaaggugaagcauacuuagauaaacaaagugauacacaauacguauguaaaagaaccuuaguugauagagguuggggaaaugguuguggacuauuuggaaaaggaaguuuaguuacaugcgcaaaauuugcauguaguaaaaaaaugacaggaaaaucaauacaaccagagaauuuagaauauagaauaaugcuuaguguacauggaagucaacauagcggaaugauaguaaaugacacaggacaugaaacugaugaaaauagagcaaaaguagaaauaacaccaaauucacccagagcagaagcuacauuaggaggauuuggaucauuaggauuagacugugaaccuagaaccggauuagauuuuucagaucuauauuacuuaacaaugaauaauaaacauugguuaguacauaaagaaugguuucaugauauaccguuaccauggcaugcaggcgcagauacaggaaccccacacuggaauaauaaagaagcacuaguagaauuuaaagaugcccaugcaaaacgucaaacuguaguaguacuaggaucacaagaaggagcaguacacacugcauuagccggagcuuuagaagcagaaauggauggagcgaaaggaagacuaucaucuggacaccuaaaauguagauuaaaaauggauaaauuaagauuaaaaggaguaaguuauaguuuaugcacagcagcauucacauuuacgaaaauuccagcagaaacauuacacggaacaguaacaguagaaguucaauaugcgggaacagacggaccauguaaaguaccagcacaaauggcaguugauaugcagacauugacucccguuggaagacuaauaacagcaaauccaguaauaacugaaucaacagaaaacucaaaaaugaugcuagaauuagauccaccauuuggagauucauauauaguaauaggaguaggugaaaaaaaaauaacucaucauuggcacagaagugggaguacaauaggaaaagcauuugaagcaacuguaagaggggcaaaacgaauggcaguacuaggagauacugcaugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7156 - RNA, 1741 nt, Artificial Sequence
  KF383120.1 solE mRNA Design 2 opt
ggggcgcugccuacggagguggcagccaucuccuucucggcaucaagcuuaccaugagucaaagaguaauauacuuaguaaugauauuauugauagcaccagcauauucaauuagauguauaggaguaaguaauagagauuuuguagaaggaaugaguggaggaacauggguagauguaguauuagaacauggaggauguguaacuguuauggcacaagauaaaccaacaguagauauagaauuaguaacaacaacaguaucaaauauggcagaaguaagaagcuacuguuacgaagcaucaaucucugauauggcaagugauaguagauguccgacacaaggagaagcuuauuuagauaaacaaagcgauacacaauauguaugcaaaagaacauuaguugauagaggauggggaaauggauguggauuauuuggaaaagguagucuaguaacaugugcuaaauuuacauguagcaaaaaaaugacaggaaaaaguauacaaccagaaaaucuagaauauaggauaaugcuaucaguacacggaagucaacacagcggaaugauuguaaaugacauaggacacgaaacagaugaaaaucgagcaaaaguagaaguaacuccaaauucaccuagagcagaagcaaccuuaggagguuuugggucauuaggacuagacugugaaccaagaacaggauuagauuuuagugacuuauauuacuuaacaaugaauaauaaacauuggcuaguacacaaagaaugguuucacgauauaccacuaccauggcacgcaggagcagauacuggaacaccacauuggaauaauaaagaagcauugguugaauuuaaagaugcacaugcuaaaagacaaaccguaguaguguuaggcagccaagaaggagcaguacauacagcuuuagcaggagcauuagaagcagaaauggauggagcaaaagguagauuauuuucaggacaucugaaauguagaauaaaaauggauaaauuaagauuaaaaggaguauccuauaguuuauguacagcagcauucacguuuaguaaaguaccagcagaaacguuacaugguacaguaacaguagaaguacaauaugcagguagggacggaccguguaaaguaccagcacaaauggccguagauaugcaaacauuaacaccaguaggacgauuaauaacagcaaacccaauaauaacagaaucaacugaaaauaguagaaugauguuagaauuagauccaccauuuggagauucauauauaguuauagguguaggagauaaaaaaauaacccaucauuggcauagaaguggcucaacaauagguaaggcauuugaagcgacaguaagaggagcgaaaagaauggcugugcuaggagauacugcaugggauuuuggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7157 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugcguauaaucaacgcacgaaaagagaagaaaaggcgcggcgccgacacuucagucgguaucgucggccuccuccucacaaccgccauggccgcagaagucacccgccgaggaagugcauacuacauguaccuagaccgcaaugacgccggagaagcaaucagcuuccccaccacacucgguaugaacaaaugcuacauacaaauaauggaccucggucacaugugcgacgccacgaugagcuacgaaugccccaugcucgacgaaggggucgaaccagacgacguugacugcuggugcaacacaaccucuacuugggucgucuacgguaccugccaccacaagaaaggcgaagcgcgacgaucccgcagggccgucacccugccgagccauucaacccgaaaacuacaaacccgaagccaaaccuggcucgaaucucgcgaauacaccaaacacuugauccgcgucgaaaacuggauuuucagaaacccaggcuucgcacucgcggcagccgcaauagccuggcuccucggcucaucaacaucccagaaagucaucuaccucguaaugauucuacucaucgccccagcauacucaauacggugcauaggaguguccaaccgcgacuucgucgagggaaugucaggcggcacauggguagacauaguacucgaacacggaggaugcgucaccguaauggcccaagacaaaccaaccguugacauagaacucguaaccacaaccguaagcaacauggcagaaguccgcucauacugcuacgaggcauccaucagcgacauggccuccgacagccgaugccccacccaaggagaggccuaccucgauaaacaaagcgacacccaauacgucugcaaaagaacccucguagauagagguuggggcaacggcugcggucuauucggcaaaggaagccuaguaacaugcgccaaauucgccugcuccaagaaaaugaccggcaaauccauccaaccggagaaccuugaauauagaaucaugcuguccguacacggaucccaacacuccggaaugauagucaacgacacaggccacgagaccgacgagaaccgagcaaaaguagagaucacacccaacucgccaagagccgaagccacccuagguggcuucggaucacuuggccucgacugcgaaccccggacagggcucgacuucucagaccucuacuaccucaccaugaacaacaaacacuggcuuguacacaaagaaugguuucacgacaucccacucccauggcaugcaggcgcagacaccggcacaccacacuggaacaacaaagaagcccuagucgaguucaaagacgcacacgcaaaacgccaaacagugguaguccuggguucccaagaaggcgccguccacacagcccucgccggcgcccucgaagcagaaauggacggcgcaaaaggacgccuuagcuccggccaccuaaaaugcagacucaaaauggacaaacuccgccuuaaaggcguaucauacagccucugcacagcugcauucaccuucaccaaaauacccgccgaaacccuccacggaacagucaccgucgaaguacaauacgcaggaacggauggcccuugcaaaguaccagcccagauggccgucgacaugcagacccuaacaccagucggaagacucauaaccgccaauccagucauaacagaguccaccgaaaacuccaaaaugaugcucgaacuagacccuccauuuggcgacuccuacauagucauaggcguaggagaaaagaaaauaacacaccacuggcaccgcuccgguuccaccauuggaaaagcauucgaagcgacaguacgcggggcaaaacguauggcggugcucggcgacaccgccugggacuuuggguccgucggcggcgcccucaauucacucggcaaaggaauacaucaaaucuucggagcggccuucaaaucccuauucggcggcaugagcugguucucccaaauacugaucggcacacuacucauguggcuaggccucaacaccaaaaacggcucaaucucccucaugugccuggcacucggcggcguacucaucuuccuauccacagcagugagugccgacgugggaugcuccguagacuucucgaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7158 - RNA, 2524 nt, Artificial Sequence
  ZIKV (isolate Z1106033) Polyprotein(93-804) mRNA Design 2 opt
ggggcgcugccuacggagguggcagccaucuccuucucggcaucaagcuuaccaugcgcaucaucaacgcccgaaaagaaaagaaacgacgaggagcggacacgucagucggcaucguaggauuacugcucaccacagcaauggccgccgaagucacccgcaggggcagcgcauauuacauguaccuugaccgaaacgacgcgggggaagcaauaucguuccccaccacgcuaggcaugaacaaaugcuacauccaaauaauggaccuaggccauaccugcgacgccacaaugucauacgaaugcccaaugcuagacgaaggcguagaacccgacgacguagacugcuggugcaacacaacaagcacaugggucgucuacgggacaugccaccacaagaaaggcgaagcucgcagaagcagacgcgccgucacacugccaagccacuccacccgaaaacuacaaacccgcagccaaaccuggcucgaaagccgcgaauacacaaaacaccucauacgagucgaaaacuggaucuuccgaaaccccggcuucgcccuggcagcagcagccauagccuggcuccuaggcucaagcacaagccaaaaaguaauauaccuagucaugauccuacuaaucgcgccagcguacucaauccgaugcaucggugucagcaaccgagacuucgucgaaggcaugucagguggcaccugggucgaugucguccuggaacacggcgguugcgucacggucauggcccaggauaaaccuaccguagacauagaacuggucaccacgaccguaagcaacauggcagaagugaggagcuauugcuacgaagcaucaauaucggacauggccucugauucgcgaugcccgacccaaggcgaggcauacuuggauaaacaaucagauacccaauacguauguaaacgaacgcuaguagaccgagggugggggaacgguugcggacucuuuggaaaaggcucccuaguaaccugcgccaaauucgcguguucaaagaaaaugacaggcaaaucaauacagccagaaaaccucgaauaccggauaaugcucuccguccacgggucccaacacagcggcaugauagucaacgacacaggccacgaaacagacgaaaauagggccaaagucgaaauaacaccaaacucaccacgagcggaagccacgcucggcggauucggaucccuaggccucgacugugaaccccggaccggccuggacuuuagcgaccuauacuaccucacaaugaacaacaaacacuggcucguccacaaagaaugguuucacgacaucccccugccauggcacgcgggcgcagacacuggcacaccacacuggaacaacaaagaagcucuugucgaguucaaagacgcacacgccaaaagacaaacagucgugguacucggaucccaagaaggagccguacacaccgcccucgccggcgcccucgaagccgagauggacggugccaaaggacgccucagcagcggacaccuaaaaugcagacuaaaaauggacaagcucagacucaagggcguauccuacucccucugcaccgccgccuucaccuucacaaaaauccccgccgaaacccuacacgggaccgucaccgucgaaguacaguacgccggcacagauggccccuguaaaguaccagcccaaauggccgucgacaugcaaacccugacacccgucggacgccuaauaacggccaaccccgucaucaccgaaucaaccgaaaacuccaaaaugaugcucgaacuagacccacccuucggcgacagcuacaucgucaucggggucggagaaaagaaaauaacccaccacuggcaccgauccgggucaaccaucggcaaagcauucgaagccaccguccgcggcgcaaaacgcauggcgguccugggagacacagcuugggacuucggauccgucggcggcgcccuaaacucacucggaaaaggcauucaccaaaucuucggcgccgccuuuaaaagccucuucggcggaaugucgugguucucccagauccuuauaggaacccuacuaauguggcucggcuugaacgccaaaaacggaagcauaagucugaugugccucgcacucggaggcguccuaaucuuccuaagcaccgcaguaagcgccgacguuggauguaguguagacuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7159 - RNA, 2512 nt, Artificial Sequence
  ZIKV (strain MR 766) Polyprotein(93-800) mRNA Design 2 opt
ggggcgcugccuacggagguggcagccaucuccuucucggcaucaagcuuaccaugagaauaaucaacgcccgaaaagaacgcaaacgcagaggagccgacacaagcauaggcauuaucggccuacuucucaccaccgcaauggcugcagaaaucaccagacgaggaagcgccuauuacauguaucucgacagaucagaugcaggaaaggcaaucuccuucgccaccacacucggaguaaacaaaugccacgugcaaaucauggaccucggacacaugugcgacgcgacaaugucauacgagugccccaugcuagacgagggagucgagccagacgacguagacugcuggugcaacacaaccucaaccugggucgucuacggaacaugccaccacaaaaagggggaagcacgccgaagccgcagagcggucacacuaccaagucacuccacacgcaagcuccaaacccggagccagaccuggcuagaaucccgggaauacaccaaacaccuaauaaaaguagagaacuggauauuucggaacccaggauucgcgcucgucgccguagccaucgcauggcuacuaggcuccagcacaucacaaaaagucauauaccuuguaaugauccuccucaucgcccccgcauacuccauccgcugcauaggagucagcaaucgcgacuucgucgaaggcaugucaggaggaaccuggguagauguaguacucgagcauggcggcugcgucacagucauggcacaagacaaaccaaccguagacaucgaacucgucacaaccaccgugagcaacauggcugaaguccggucauacugcuacgaggcaucaauauccgacauggccuccgacagccgcugcccaacccaaggcgaagccuaccucgacaaacagagcgacacacaauacgucugcaaacgaacccucguagacagaggcugggggaacggaugcggacuauucggcaaaggaucccucguaaccugcgccaaguucacgugcagcaagaaaaugaccggcaaauccauucaacccgaaaaccuagaguaccgcaucaugcuaucaguccacggcagucaacacucagggaugaucggcuacgaaaccgacgaagaccgcgccaaaguggaagucacaccaaacucaccacgcgccgaagcaacacuaggcggguucggaucccugggacucgacugcgagccccgcacgggccuagacuuuagcgaccuuuacuaucuaaccaugaacaacaaacacuggcuaguacacaaagagugguuccacgacaucccacuaccguggcacgcaggggcagauaccggcacaccgcacuggaacaauaaagaagcccuaguagaguucaaagacgcacacgccaaacgacaaaccguaguggucuuaggaucccaggaaggagccguacacaccgcccucgccggagcccuagaagccgaaauggacggcgccaaaggccgccuauuuucgggccaccucaaaugccgccugaaaauggacaaacuacgccuaaaagggguaaguuacucccucugcaccgccgcauucacauucacuaaagucccagccgaaacccuccacggcacaguaacaguagaaguccaauacgccggaaccgacggacccugcaaaauccccguacaaauggcaguagauaugcaaacccuaacccccgucggccgccuaauaacagccaaucccguaauuaccgaauccacagagaacagcaagaugaugcucgaacuugacccacccuucggcgacucguacauagucaucggagucggcgacaagaaaauuacacaccacuggcaccggucaggaucgacaaucggcaaagcguucgaggcaaccguacgaggagccaaaagaauggccguacuaggugacaccgcgugggacuucggcuccguagggggcguauucaacucccuaggaaaaggaauccaccagaucuucggcgccgcauucaagucacuauucggggguaugagcugguucagccaaauccuaaucggcacccuacugguguggcucggucucaacaccaaaaacggaucaaucucccucacaugccuagcauuagggggagucaugaucuuccucagcacagcagucucagccgacgugggaugcagcguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7160 - RNA, 2524 nt, Artificial Sequence
  ZIKV (strain NatalRGN) Polyprotein(93-804) mRNA Design 2 opt
ggggcgcugccuacggagguggcagccaucuccuucucggcaucaagcuuaccaugagaaucaucaacgccaggaaagaaaagaaaagacgaggagcagauaccaguguaggcauaguaggcuuacuccucacuacagcaauggcagccgaaguaacaagacggggcuccgcguacuacauguaccucgaccgaaacgacgcaggagaggcgaucagcuuccccacgacgcuagggaugaacaaaugcuacauacaaaucauggaccucggccacaugugcgacgcaacaaugagcuacgaaugccccaugcuggaugaaggaguggagcccgacgacguagacugcuggugcaauaccacaaguaccugggugguguacggaacaugccaccacaagaaaggcgaagcccgacgaucgcgccgagccguaacucugccgucccauucgaccagaaaacuccaaacaagaucacagacauggcuagagucacgggaauauacaaaacaccucauccgcguagaaaacuggauauuccgaaacccgggcuucgcccucgcagcggcagcaaucgccuggcugcuggggaguucgaccagccaaaaagucauauaccuaguaaugauccuacucaucgcaccggcuuacagcauacgcugcauaggagucucaaaccgagacuucgucgaaggaaugagcggcggcaccuggguagacguaguacucgagcacggcgggugcguaaccgucauggcacaagacaaaccaacaguagacauugagcuagucacgacaacaguauccaacauggcugaaguaagaaguuacuguuacgaagccagcaucagcgacauggcaagcgacucucgcugccccacccaaggagaagccuaccucgacaaacagucagacacccaguacguauguaaacgaacgcuaguagacagaggcuggggcaacggauguggccuuuuuggaaaaggauccuuagucacaugcgccaaauucgccugcagcaagaaaaugacagggaaaucaauccagccagaaaaccuagaauaccggaucaugcucagcguccacggcucccagcacucgggaaugaucguaaacgacacaggccacgaaacagacgaaaaucgcgccaaaguagaaauaaccccgaacagcccccgcgcagaagccacucuaggagguuucggaagccucggucuagacugcgagccccgcaccgggcuagacuucagugaccuauacuaccugacaaugaacaacaaacacuggcuaguccacaaagaaugguuccaugacaucccacuaccguggcacgcaggcgcagauaccggcaccccacacuggaauaacaaagaagcccucgucgaguucaaagacgcgcacgccaaacgccaaacuguggucguacucgggagucaggaaggcgcaguacacaccgcacucgcaggcgcccuagaagcagaaauggacggcgcaaaaggacgccuauccagcggacaccucaaguguagacuaaaaauggacaaacuccgacucaaagguguaagcuacucccuaugcacggcagcauucaccuucacgaaaauaccagcggaaacacuccacggaacaguaacaguagaaguccaauacgcagggacugacgggccaugcaaaguacccgcgcaaauggcaguagacaugcaaacacucacaccggucggacgacuaauaacagcaaacccgguaaucaccgaaagcaccgaaaacagcaaaaugaugcucgaacuagacccacccuucggagacucauacaucgucaucggcguaggagaaaagaaaaucacgcaccacuggcacagaucaggaucgacuauaggcaaagccuucgaagcaacagucagaggggccaaacgcauggcaguacugggggacacagccugggacuucggguccgucggcggggcucuaaacagccuaggcaaagggauacaccaaaucuucggcgcagcauucaaaucacucuucggcggcaugagcugguucagccaaauccuaaucggaacacuacucauguggcuaggguuaaacaccaaaaacggcagcaucagccucaugugcuuagcccuaggcgggguacucauauuucuaagcacagcaguaagcgccgacguaggaugcagcguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7161 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugacguccguaggcaucguggggcuccugcuaacgacggccauggcagcagagguaacccgccgaggcucagcauacuacauguaccuagaccgaaacgacgcgggagaagccaucagcuuccccaccacccucggaaugaacaaaugcuacauccaaauaauggaccucggccacaugugcgacgcgacaaugucauacgaaugcccaauguuagacgaaggggucgaacccgacgacgucgacugcuggugcaacaccacaagcacauggguaguauacgguaccugccaccacaagaaaggcgaagccagacgcagccgcagagccguaacccucccgucccacagcacacggaaacuccagacacggagucaaacauggcuggaaucgcgcgaauacaccaaacaccuuauaagaguagaaaacuggaucuuccgaaacccgggcuucgcgcucgccgcagccgccaucgcauggcuccugggguccagcaccagccaaaaagucauauaccucgucaugauccuccucauagcccccgccuacuccauccgcugcaucgguguguccaaccgagacuucguagaaggaaugucgggaggaacauggguagacauaguccucgaacacggcgggugcgucaccgucauggcgcaagacaaaccaacaguagacauagagcuaguaacaacaacagucagcaacauggcugaaguccgauccuacugcuacgaagcaucaaucagcgacauggcaucugacagucgaugccccacacaaggugaagccuaccucgacaaacagucagacacacaauacguaugcaaacgcacacucguagacagaggcuggggcaacggaugcggacuguucggcaaaggcucacugguaacaugcgccaaauucgcaugcagcaagaaaaugacaggcaaaagcauccaaccagaaaaccuagaauaccgcaucaugcuaagcguccacggaagccaacacagcggcaugauagucaacgacaccgggcacgaaacagacgaaaaccgagccaaagucgaaaucacgccaaacagcccccgcgccgaagcaacacuaggcggcuucggaagccucggccuagacugcgaaccacgcacaggacuagacuucagcgaccuauacuaccucacuaugaacaacaaacacuggcuaguacacaaagaaugguuccacgacauaccccucccuuggcacgccggcgccgacaccgguacaccccacuggaacaacaaagaagcccucguagaguucaaggacgcucacgccaaacgacaaaccgucgucguucucggaucccaagaaggcgcaguacacacagcacuagccggcgcccuagaagcugaaauggacggagccaaaggacgccuaucaucaggacauuuaaagugccgccucaaaauggacaaacuccgacucaaaggagucuccuacagccugugcacagcagccuucacauucacaaaaauacccgcagagacccugcacggaaccguaaccguagagguccaauaugccggaaccgacggccccugcaaagucccagcccaaauggcagucgacaugcaaacacucacccccguaggaagacuaaucaccgcaaacccaguaaucaccgaaaguaccgaaaacagcaaaaugaugcuagaacucgaucccccauucggcgacagcuacauagucaucggggucggcgaaaagaaaaucacccaccacuggcaccgcucaggaucaacaauaggaaaagcauucgaggcaaccguacgcggcgccaaacgcauggccguccuaggagacacagcaugggacuuuggcuccguaggaggcgcgcucaacagccucggaaaaggaauacaccaaaucuucggggccgccuucaaaucccuauuuggaggaaugucgugguucucgcaaauccucauaggcacacuccugauguggcucgggcuaaacaccaaaaacggcuccaucagucuaaugugucucgcccucggaggaguccuaaucuuccuaagcacagcuguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7162 - RNA, 2449 nt, Artificial Sequence
  ZIKV (isolate Z1106033) Polyprotein(108-794) mRNA Design 2 opt
ggggcgcugccuacggagguggcagccaucuccuucucggcaucaagcuuaccaugaccagcgucggaauuguaggacugcuccuaacgacagcaauggcagccgaaguaaccagaagaggcuccgcauauuauauguaccucgaccggaacgacgccggagaagccaucuccuucccaaccaccuuagguaugaacaaaugcuacauccaaaucauggaccucggacacacgugcgacgcaaccauguccuacgaaugcccaaugcuagacgaaggcguagaaccagacgacguagacugcuggugcaacaccaccucgacuuggguaguauacggaaccugccaccacaaaaagggcgaagcacgccgaucacgcagagccgucacccuccccucacacagcacccgaaaacugcaaacacggucccaaaccuggcucgaaagccgagaauauacuaaacaccucauaagaguagagaacuggauuuucagaaacccgggcuucgcccucgccgcggcggcaauagcauggcuccuaggcuccuccacaucgcaaaaagugauauaucucgucaugauacuacucaucgccccagcauacuccauacgaugcaucggcguauccaauagagacuucgucgaaggaaugagcggaggcacguggguggacguaguccucgaacacggcggcugcguaaccgucauggcacaagauaaaccaacgguagacaucgaacucgucacaaccaccguaucaaacauggcugaaguccgauccuacugcuacgaagccuccaucagcgacauggcauccgacucacgcugccccacccaaggcgaggccuaccuggacaaacaaucagacacccaauacgucuguaagcgcacccugguggaccggggcuggggcaacgggugcggacucuucggcaaaggcagccucguaacaugcgcaaaauucgccugcagcaagaaaaugacaggaaaaagcauccaacccgaaaaccucgaauaccgaauaaugcuaagcguacacggaucccaacacuccgguaugauaguaaacgacacaggccacgagaccgacgaaaaccgcgccaaagucgaaauuacccccaauucgccccgagcagaagcuacccuaggaggguuuggcucccuaggacuggacugcgaaccacgcaccggacuagacuucuccgaccuauacuaccucaccaugaacaacaaacauuggcuaguacauaaggaaugguuccacgacaucccacuacccuggcacgccggagccgacacaggcacaccccacuggaacaacaaagaggcacucguagaguucaaagacgcccacgccaaaagacaaaccgucgucguucucggcucacaagaaggcgccguacacacggcccucgcuggugcccuggaagccgaaauggacggagccaaaggacgccucuccagcggccaccuaaaaugccgccuaaaaauggacaaacuccgccucaaaggcguauccuacucacucugcaccgccgccuucaccuucaccaaaauacccgcagaaacgcuccacggcacaguaaccgucgaaguacaguacgcuggaacggauggucccugcaaaguacccgcccaaauggcaguagacaugcaaacccucacccccguaggccgccucaucaccgccaacccaguaaucacagaaucaaccgaaaacucgaaaaugauguuagaacucgacccacccuucggagacucauacaucgucaucggcgucggcgagaaaaagaucacgcaccacuggcaccgcagcggcucaacaaucggaaaggccuucgaagcaaccguaagaggagccaaacgcauggccguacucggcgacaccgcaugggacuucggcuccgucggcggagcacuaaacucccucggcaaaggaauccaccaaaucuuuggcgcagcuuuuaaaucccucuucggcggcaugucaugguucucucaaauccucaucggcacacuccuaauguggcucggguuaaacgcuaaaaacggcuccaucagccucaugugccuagcacucggcggaguacuaauauuccuaucaaccgcaguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7163 - RNA, 2437 nt, Artificial Sequence
  ZIKV (strain MR 766) Polyprotein(108-790) mRNA Design 2 opt
ggggcgcugccuacggagguggcagccaucuccuucucggcaucaagcuuaccaugacauccauaggcaucauaggauuacuacuaaccaccgccauggccgccgaaauaacacgccggggauccgcuuacuauauguaccucgaccgcagugacgccggcaaagcuaucagcuucgcaaccacucuaggaguaaauaaaugccacguucaaaucauggaccuaggccacaugugcgacgccacaauguccuacgaaugccccaugcuagacgaagguguagagccggacgacgucgacugcuggugcaauaccaccagcaccugggucgucuacggcacgugccaccacaagaaaggagaagcacgucguucccgacgcgccguuacucugccaagccacuccacccguaaacuccagaccagaucacaaacauggcuagaguccagagaauacaccaaacaccucaucaaagucgagaacuggauauuccgaaaccccggcuucgcccucgucgccgucgcaaucgccuggcuacucggauccagcacuucacagaaagucaucuaccucgucaugauccuacucaucgccccggcuuacagcauccgaugcaucggagugagcaaccgugacuucgucgaaggcaugucuggcgguaccuggguagacgucguccuagaacacggaggcugcgucaccguaauggcccaagacaaacccacugucgacauagaacucgucacaacaaccgucagcaauauggcagaaguccgcuccuacugcuacgaggccuccauaagcgacauggcaucagacucccgcugcccaacccaaggagaagccuaccuggacaaacaauccgacacgcaauacgucugcaaaagaaccuuagucgaccgcggauggggaaacgggugcggccuauucggcaaaggcucgcucguaaccugcgccaaguucacaugcagcaaaaagaugacgggcaaaagcauacaaccggaaaaccucgaauacagaauaaugcucucgguccacggcucccaacacagcggaaugauuggauacgaaacugacgaggacagagccaaagucgagguaaccccaaacuccccgcgcgcugaagccacccuaggaggcuucggaagccugggccuugacugcgaaccccgaacaggacuggacuucucagaccuguacuacuugaccaugaacaacaaacacuggcugguccauaaagaaugguuccacgacaucccccuuccauggcaugcaggcgcagacaccggcacaccccacuggaacaacaaagaagcccucgucgaguucaaggacgcacacgcaaaacgucaaaccguugucguccuaggcucacaagaaggagcaguucacaccgcccucgcgggcgcccuagaggcagaaauggacggagccaaagggcgccucuucagcggccaccuaaaaugccgccuaaaaauggacaaacuccgccugaaaggaguaucguacucccucugcaccgcagcauucaccuucaccaaaguacccgcggagacccuacacggaacaguaaccguugagguccaauaugccggaaccgacggcccaugcaagauccccguacagauggccguagacaugcaaacacugacaccagucggacgccuaaucaccgcaaaccccgugaucacagaguccaccgaaaacagcaaaaugaugcucgagcucgacccaccuuucggcgacagcuacaucgucauaggagucggagacaagaaaauaacccaccacuggcaccgaagcggguccacgaucggcaaagccuucgaagcgacaguuagaggagccaaacguauggccguacuuggcgacaccgccugggacuucggaagugucggcggcgucuucaacucacucggcaaaggaauccaccaaaucuucggagccgcguucaaaucacuauucggaggaauguccugguucucccaaauccuuauaggaacacuccugguauggcuaggucuaaacaccaaaaacggcagcauaucccuaaccugccucgcgcucggcggugucaugauauuccucucuaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7164 - RNA, 2449 nt, Artificial Sequence
  ZIKV (strain NatalRGN) Polyprotein(108-794) mRNA Design 2 opt
ggggcgcugccuacggagguggcagccaucuccuucucggcaucaagcuuaccaugaccaguguaggcaucgucgggcuccuacucaccacggccauggcggcagaggucacccgacguggauccgcauauuacauguaccucgaccgaaacgacgccggggaagcgauauccuucccgaccacccucggaaugaacaaaugcuacauacaaaucauggaccuaggacacaugugcgacgcaacaaugagcuacgaaugcccaaugcucgacgaaggcguggaaccagacgacgucgacugcuggugcaacaccaccuccacauggguaguauacggcacaugccaucacaagaaaggcgaagcccgacgguccagacgcgcugugacacucccaagccacagcacaagaaaacuccaaacacgcucccagaccuggcucgaaagccgggaauauacaaaacaccucauacgcgucgaaaacuggauauuccgcaacccgggguucgcacucgcggccgccgccaucgcauggcuccuuggcagcagcacuucacaaaaagugauauaccucguaaugauccuccugaucgcgcccgccuacuccauccgcugcauaggcgucagcaaccgcgacuucguggaaggaauguccggcggcacgugggucgacgucguacucgaacacggaggcugcgucacaguaauggcccaagacaaaccaacggucgacaucgaacuuguaaccaccacaguaagcaacauggccgaaguccgcucauacugcuacgaggcaagcauauccgacauggcaucagauucacgcugccccacccaaggagaagccuaccuggacaaacaaucagacacacaauacguaugcaaacggacccucguagaccgcggcuggggcaacggcugcggacucuuuggcaaagguucgcucguaaccugcgccaaauucgccugcuccaaaaagaugaccggaaagucaauccaacccgagaaccucgaauaccgaaucaugcucucgguccacgggucccaacacaguggcaugaucgucaacgacacgggacacgaaacagacgagaacagagccaaaguagaaaucacccccaacuccccaagagcggaagcaacacucggcggcuucggcagccuuggccuagacugcgaaccacgaaccggacuggacuucagugaccucuauuaccuaacaaugaacaauaaacacuggcucguacacaaagaaugguuccacgacauaccgcuacccuggcacgcgggugccgacaccggaaccccacacuggaauaacaaggaagcccuagucgaauuuaaagacgcacacgccaagagacaaacagucguaguacuaggcucacaagaaggcgcaguacacacagcccuagcaggagcgcucgaagccgaaauggacggcgcgaaaggccgacugagcagcggccaccuaaaaugccgacuaaaaauggacaaacuacgccuuaaaggagugucauacagccucugcacagcggcauucaccuucaccaagauaccugcagaaacacuucacggcaccguaaccgucgaaguacaauaugccggaacagacggcccaugcaagguacccgcgcaaauggccgucgacaugcaaacccuaacccccguaggacgacuaaucacagcaaaccccgucaucaccgaaucgacagaaaacucaaaaaugaugcuagaacuagaucccccauucggcgacucauacauagucauaggcgucggcgaaaagaaaaucacacaccauuggcaccgauccggaagcacaauaggaaaagcauucgaggcaacaguaagaggcgccaaacgcauggcaguccucggcgacacagcaugggacuucggcagcguaggaggagcacuaaacucccugggaaaaggaauacaccaaauauucggcgccgcauucaaaagccucuucggagggaugagcugguucucccaaauccuaaucgggacccuccugauguggcuaggccuaaacaccaaaaacgggagcaucagccucaugugccuagcacuaggcggcguccuaauauuccuaucaaccgcaguuagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7165 - RNA, 1741 nt, Artificial Sequence
  ZIKV (strain ZikaSPH2015) Polyprotein(273-723) mRNA Design 2 opt
ggggcgcugccuacggagguggcagccaucuccuucucggcaucaagcuuaccaugucacaaaaagucauauaccuggucaugauccuacucaucgccccagccuacagcauacgcugcauaggaguaucgaaccgagacuuugucgagggcaugagcggaggcacaugggucgacaucguccucgaacacggcgggugcgugacaguaauggcacaagacaaaccgacaguggacauagagcuagucacaaccacggucucgaacauggcagaaguaaggagcuacugcuacgaagccagcauaagcgacauggcaucagacucaaggugcccaacacaaggcgaggcuuaccucgacaaacaaagcgacacccaauacgugugcaaacgcacccuaguagaccgcgguuggggcaacggaugcggccuguucggcaaagggagccuagucacaugcgcgaaauucgccugcagcaagaaaaugacuggaaaaagcauccagccggaaaaucucgaauaccgcauaaugcucagcgugcacgggagccaacacucaggaaugaucgugaacgacaccggacacgaaacagacgaaaacagagcgaaaguagaaauaaccccaaacucaccaagagccgaagccacacuaggaggauucggcucgcuaggccuugacugcgaaccccgaaccgggcuagacuucucggaccucuauuaccucaccaugaacaacaaacacuggcucguccacaaagaaugguuccacgacauaccgcuacccuggcacgcaggcgcagacacaggcacaccccacuggaacaacaaagaggcccucguagaauuuaaagacgcccacgcaaaacgccaaacaguggucguacuagggagccaagaaggggcaguucacacggcccuagccggagccuuagaggcggaaauggacggagcgaaaggacgccucucgagcggccaucuaaaaugucgccugaaaauggacaaacucaggcucaaaggcguauccuacagccuauguaccgccgcguucacauucacaaaaauacccgcagaaacgcuacacggcacaguaacagucgagguacaauacgcaggcacagacgggcccugcaaaguacccgcgcaaauggcgguagacaugcaaacccuaacacccgucggcagacuaauaaccgcaaacccaguaaucacagagagcacagagaacagcaaaaugaugcucgagcucgacccaccguucggagacucauacauagucauaggcgugggcgaaaagaaaauaacgcaccacuggcaccgcuccggaucaaccauaggcaaagccuucgaagccaccguacgaggcgccaaaagaauggccgugcucggagacacagccugggacuucggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7166 - RNA, 1741 nt, Artificial Sequence
  ZIKV (isolate Z1106033) Polyprotein(273-723) mRNA Design 2 opt
ggggcgcugccuacggagguggcagccaucuccuucucggcaucaagcuuaccaugucccaaaaagucauauaccuaguaaugauacuacucauagccccagcauacagcauccgcugcaucggcguaucaaacagggacuucguagaaggcaugagcggaggaacauggguagacguaguccuagaacacggcggaugcgugaccguaauggcacaagacaaaccgaccguagacauagagcuagucaccacaaccgucuccaacauggcagaagucagaagcuacugcuacgaagcaagcaucagcgacauggccagcgacagccggugcccgacccaaggggaagccuaccuagacaaacagagcgacacacaauacgugugcaaacgcacacucguagaccgcggauggggcaacggcugcggacuguucggcaaaggaagucuagucacgugcgcaaaauucgccugcagcaagaaaaugaccggcaaaucgauccaacccgaaaaccucgaauaccgcaucaugcuaagcgugcacggcagucagcacucggguaugaucgugaacgacacaggacacgaaacagacgaaaaucgcgcaaaaguggaaauaaccccaaacucccccagagccgaggccacccucggaggcuucggcucgcucggacucgacugcgaaccccggaccggccucgacuucuccgaccuguacuaucuaacgaugaacaauaaacacuggcucguacacaaagaaugguuccacgacauacccuuacccuggcacgccggcgcagacacaggaacgccacacuggaacaacaaagaagcccucguggaguucaaagacgcacacgccaagcgccaaaccgucguaguacuaggaucccaagaaggcgccguacacacggcccuagccggagcccuggaagcggaaauggacggagcaaaaggcagacucagcagcggacaccugaaaugccgacugaagauggacaaacuaagacucaaaggcgugagcuacagccucugcacagccgcauucacguucacaaagauacccgcagaaacacuacacggcacaguaacagucgaaguccaauacgccggcacggacgggcccugcaaaguacccgcacaaauggcaguggacaugcaaacgcucacacccgugggaagacuaauaacagcaaacccagucauaacagaaagcacagaaaacagcaaaaugaugcuagaacucgacccacccuucggcgacucguacauagugauaggcguaggagaaaagaaaauuacacaucacuggcaccgcucaggcagcacaauaggcaaagccuucgaagcaacgguccgcggagcaaaacgcauggccgugcucggagacaccgccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7167 - RNA, 1729 nt, Artificial Sequence
  ZIKV (strain MR 766) Polyprotein(273-719) mRNA Design 2 opt
ggggcgcugccuacggagguggcagccaucuccuucucggcaucaagcuuaccaugucgcaaaaaguaaucuaccuagucaugauccuacuaaucgcccccgccuacuccauacgaugcaucggaguaagcaacagagacuucgucgaaggaaugagcggcggaaccugggucgacguaguccuggaacauggcggcugcgucaccgucauggcccaagacaaacccaccguagacauagaacucgucacaacaacaguauccaacauggcugaaguccgaagcuacugcuacgaagccucaauaagcgacauggccucagacagcagaugccccacccaaggagaagcauaccuagacaaacaaagcgauacacaauacguauguaaacgcacacuggucgaccgcggauggggaaacggcugcggccucuucggcaaaggcagucucguaaccugcgccaaauucacaugcagcaagaaaaugaccggaaaauccauacaaccugaaaaccucgaauauagaaucaugcuaucgguccacggaagccaacauucgggcaugaucggcuacgaaaccgacgaagaccgcgccaaaguagaagucacaccgaacaguccccgagcagaagccacccuaggcggcuucggaucccucggccuagacugcgaacccagaaccggauuagacuucagcgacuuauacuaccucaccaugaacaacaaacacuggcucguccacaaagaaugguuccacgacauaccccuaccauggcacgccggcgcagacaccggcaccccgcacuggaacaacaaagaagcccuagucgaguucaaagacgcacacgccaaacgccaaaccguagucguacucggaagccaagaaggcgcaguacacaccgcccuggccggagcccucgaagccgaaauggacggcgccaaagggagacucuucagcggacaccuaaaaugcagacucaaaauggacaaacuccgccuaaaaggcguguccuacucccuaugcacagcagccuucacguucacaaaagugccagccgaaacacuacacggcacaguaaccgucgaaguccaauacgcgggaacagacggcccaugcaaaaucccaguccaaauggcagucgacaugcaaacacucacccccgucggacgacuaaucaccgccaacccagucaucaccgaauccacagaaaacucaaaaaugaugcucgaacucgacccacccuucggagacuccuacaucgucauaggagucggcgacaaaaagaucacccaccacuggcacagaagcggcagcaccauaggcaaagccuucgaagcaacaguacgcggagcaaaacgcauggccguccuaggcgacaccgccugggacuucggguccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7168 - RNA, 1741 nt, Artificial Sequence
  ZIKV (strain NatalRGN) Polyprotein(273-723) mRNA Design 2 opt
ggggcgcugccuacggagguggcagccaucuccuucucggcaucaagcuuaccaugagccaaaaagucauauaccucguaaugauccuacucauagccccggccuacagcauccgcugcaucggaguaucaaacagagacuucguagaaggcaugagcgggggaacauggguagacguaguccucgaacacggaggaugcguaacaguaauggcacaagacaaaccgaccguagacauagaauuagucacaaccacagucucaaacauggccgaaguccgcagcuacugcuacgaagcgagcauaagcgacauggcaagcgauucaagaugccccacccagggggaagccuaccuagacaaacaaagcgacacccaguacguaugcaaacgaacccucguggaccgcggauggggaaacgguugcggccuauucgggaaagggagccuagucacaugcgcaaaauucgcaugcagcaagaaaaugaccgggaaaagcauacaaccagaaaaccuagaauaccgcaucaugcugagcguacacgggagccaacacucaggaaugaucgucaacgacaccggacacgaaacagacgaaaaccgagccaaaguagaaauaaccccuaacucaccacgagccgaagcgacacugggcggauucggcucgcucggacuugacugcgaaccccggaccggacuagacuucucggaucuauacuaccucacgaugaacaacaaacacuggcucguacacaaagaaugguuccacgacauaccccuacccuggcacgcgggcgccgacacaggaacaccccacuggaacaacaaagaagcacucguagaguucaaagacgcacacgccaaacgccaaaccguagucguacuaggaagccaagaaggcgccguccacacggcacuagccggagccuuagaagccgaaauggacggcgccaaaggccggcuaucaagugggcaccugaaaugcagacugaaaauggacaaacucaggcucaaaggagugagcuacagccugugcacggcagcauucacauucacaaaaauaccagcggaaacacuccacgggaccgucacggucgaaguccaauacgcaggcacagacggacccugcaaaguacccgcgcaaauggccgucgacaugcaaacgcucacaccaguaggcaggcucauaacagcaaacccaguaauuaccgaaagcacagaaaacagcaaaaugaugcuagaacucgacccaccauucggagacucauacauagucaucggcguaggagagaagaaaauaacacaccacuggcaccgaucaggcuccacaaucggcaaagccuucgaggcaaccgucagaggagccaaacgcauggcagugcucggagacacggccugggacuucggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7169 - RNA, 2449 nt, Artificial Sequence
  ZIKV (strain ZikaSPH2015) Polyprotein(108-794)(F398S) mRNA Design 2 opt
ggggcgcugccuacggagguggcagccaucuccuucucggcaucaagcuuaccaugacaagcguaggcauagucggcuuacugcucacgaccgccauggcagcggaaguaaccagacgaggaagcgcauacuauauguaucuggaccgaaacgacgccggcgaagcaaucagcuuccccacaacgcucggcaugaacaaaugcuacauacagaucauggaccucgggcacaugugcgacgccacgaugaguuacgagugccccaugcucgacgagggagucgaaccagacgacgucgacugcuggugcaacaccaccagcaccugggugguauacggcacaugccaccacaagaaaggagaagcacgccgcucucgacgagccguaacacuccccucccacagcaccagaaaacuccagacaagaucacaaacauggcuagaaucacgcgaauacacaaaacaccucauaagggucgaaaacuggauauucagaaaucccggauucgcccucgccgccgccgcgaucgcaugguuacucggcuccuccaccagccaaaaagucauauaccuagugaugauacuccucaucgcuccagcauacuccauccggugcauaggaguauccaaccgagauuuuguggagggaaugucgggaggcaccugggucgacaucguccucgagcacggaggcugcguaacagucauggcacaagacaaacccacagucgacauagagcuaguuaccacaaccguauccaacauggccgaaguaagaucguacuguuacgaagcaagcaucagcgacauggccagcgacagccgcugcccuacccaaggcgaagccuaccucgacaaacaguccgacacacaauacguauguaaacgcacccuagucgacagagguugggguaacggcugcggacucagcggcaaaggcagccucgugaccugcgcgaaauucgccugcucaaagaaaaugaccggcaaauccauacaacccgaaaaccuagaauaccgcaucaugcucucgguccacggaucacagcacucaggcaugauagucaaugacacaggacacgaaaccgacgaaaaccgagcuaaagucgaaaucaccccaaacagcccacgcgccgaagccacgcucggaggcuucggaucacuagggcuagacugcgaaccccgcacaggacuagacuucagcgaccucuacuaccugacaaugaacaacaaacacuggcucguucacaaagaaugguuccacgauaucccccuacccuggcacgcaggagccgacacaggaaccccacacuggaacaacaaggaagcccucguagaguucaaagacgcacacgccaagcgacaaaccgucguaguauuaggcucgcaagaaggcgcaguacacacagcccucgccggcgcacucgaagcagaaauggacggcgccaaagggcgacuaaguagcggccaucucaaaugccgacucaaaauggacaaacuccgacuaaaaggcgucucauacucccuaugcaccgcagcauucaccuucaccaaaaucccggccgaaacacuccacggaaccgucaccgucgaaguacaauacgcaggaacggauggcccguguaaaguucccgcgcaaauggccgucgacaugcaaacgcuuacaccagucggcagacucauaacagccaacccaguaauaaccgaaagcacagaaaauagcaagaugaugcucgaacuagacccacccuucggagacuccuacauaguaaucggcguaggagaaaagaaaaucacccaccacuggcaccgaagcggaagcacgaucggcaaagcauuugaagccaccgugcgcggcgccaagagaauggccguacucggcgacacagccugggacuucgguuccgucggaggcgcacuaaacucacugggcaaaggcauacaccaaaucuuuggagcagccuucaaaagccucuucggaggcaugucaugguucucccagauacucaucggcacccuacucauguggcuaggccugaacaccaagaacgggucaauaucacuaaugugccuagcccucggcggaguacuaauauuccugagcaccgccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7170 - RNA, 2449 nt, Artificial Sequence
  ZIKV (isolate Z1106033) Polyprotein(108-794)(F398S) mRNA Design 2 opt
ggggcgcugccuacggagguggcagccaucuccuucucggcaucaagcuuaccaugacgagcgucggcaucgucggacugcuucucacaaccgcgauggcagccgaaguaacccgcagaggauccgcauacuacauguaccuagaccgaaacgacgccggagaagccaucagcuucccaaccacccugggaaugaauaaaugcuacauacagaucauggaccugggccauaccugcgacgcgaccauguccuaugagugcccaaugcuagacgaaggaguagagcccgaugacgucgacugcuggugcaacacaacuucgaccugggucguguacggaaccugccaccacaagaaaggcgaagcacggcgaucaagacgagccgucacacuaccaagccacagcacccgcaagcuacaaacacgaagccagacauggcuagaaucccgagaguacaccaaacaccuaauccgaguagagaacuggaucuuccgcaacccaggcuucgcacuugccgcggccgcaaucgccuggcugcucggcagcagcacaagucaaaaggucaucuaccuggucaugauacuccuaauagcgccggccuacagcauccguugcaucggcgucuccaaccgagacuucguugaaggcaugucaggaggcacauggguagacguaguacucgagcacggaggcugcguaaccgugauggcgcaggacaaaccaacaguagacaucgagcuagucaccacaaccgugucgaacauggcugaagucaggagcuacugcuaugaagcaucaauaucagacauggcaagcgacuccagaugccccacacaaggcgaagccuaccucgacaaacaaucugacacccaauacgugugcaaaaggacccuaguagaccggggcuggggcaacgggugcggccuaagcggcaaaggcagccuaguaaccugcgccaaauucgcaugcuccaagaaaaugacaggcaaauccauccaaccagaaaaccuagaauacagaaucauguuaucaguccacggaagccaacacucaggcaugaucgucaacgacaccggacacgaaacagacgaaaaccgcgcgaaaguagaaauaaccccaaacucacccagagcagaagccacacugggcggcuucggcucccucggacuggacugcgaaccccgaaccgggcuagacuucucagaccuauacuaccucacaaugaacaacaaacacuggcucguccacaaagaaugguuccacgacaucccacuccccuggcacgcaggcgccgacaccggcacaccacacuggaauaacaaagaagccuuaguggaguucaaagacgcacaugccaaaagacaaaccgucgucguacuaggcagucaagaaggcgcaguacacacagcgcucgcgggcgcgcuggaagccgaaauggacggagcaaaaggcagguuaucaagcggccaccucaaaugccgacuaaaaauggauaaacuacgccucaaaggcguaagcuacagccucugcacagcagcauucaccuucaccaaaauacccgccgaaacacugcacggcacaguaacagucgaaguccaauacgcaggcaccgacggaccaugcaaaguccccgcccagauggccgucgacaugcaaacccucacucccguagggcgcuuaaucaccgccaacccagucaucacagaauccacagaaaacaguaaaaugaugcucgaacucgacccgccuuucggagacuccuacaucguaaucggcguaggcgaaaagaagaucacccaucacuggcacagaucagguagcaccaucggcaaagcguucgaagcaaccgugcgcggcgcgaaacgcauggcaguucucggcgacacugcaugggacuuuggcucaguaggaggcgcacucaacagccuaggaaaaggaauacaccaaauauucggcgccgcauucaaaagccuauucggcggaaugucaugguucagccaaauacucauuggcacccuccucauguggcugggccucaacgccaaaaacggcuccauaucgcucaugugccucgcacuaggcggcguauuaauauuccucucaacagcugucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7171 - RNA, 2437 nt, Artificial Sequence
  ZIKV (strain MR 766) Polyprotein(108-790)(F398S) mRNA Design 2 opt
ggggcgcugccuacggagguggcagccaucuccuucucggcaucaagcuuaccaugaccuccauaggcauaaucggccuacugcuuacgacagcaauggccgcagaaauaacacgacggggcuccgccuacuacauguaccucgaccgcucggacgccggaaaagcaaucaguuucgcuacaacccucggcguaaacaaaugccacguccaaaucauggacuuaggccacaugugcgacgcgacuauguccuacgaaugccccauguuagacgagggcgucgaacccgacgacgucgacugcuggugcaacaccaccucgacauggguagucuacggcacuugccaucacaagaaaggagaagcacgccguucaagacgagcagucacccuacccagccacagcacacgaaaacuacaaacccgcucccaaaccuggcuagaaagccgcgaauacaccaaacaccucauaaaagucgaaaacuggauauuccgaaaccccggcuucgcacucgucgccguagccaucgcauggcuccuaggauccagcaccagccagaaagucauauaccuagucaugauucuacucaucgcaccggcauacuccauacgcugcaucggaguaagcaacagagacuucgucgaagguauguccggcggcacuugggucgacgucguccucgaacacggaggaugcgugacagucauggcacaagacaaaccaacaguggacaucgaacucguaaccaccaccgucagcaacauggccgaaguccgaagcuacugcuacgaagccagcaucagcgacauggcuucagacagccgcugcccaacgcaaggggaagccuaccucgacaaacaaucagacacccaauacguaugcaaacgcacccuggucgaucgcggauggggcaacgggugcggccuuucuggcaaggggucccuaguaaccugcgcaaaauucaccuguucaaagaaaaugaccggcaaauccauccaaccugaaaaccucgaauaccguauaaugcucaguguccacggaucccaacacagcggaaugaucggcuacgaaacagacgaagaccgcgccaaaguagaaguaacccccaacucgccacgagccgaggccacacuaggcgguuucggcucccuaggacucgacugcgaaccucgcacagggcucgacuucuccgaccuauacuaccugacaaugaacaacaaacacugguuaguccauaaggaaugguuccaugacauaccccuccccuggcacgcuggcgccgacacaggcacaccgcacuggaacaacaaagaagcucuaguagaauuuaaagacgcccacgccaaacgacaaacagucguuguccuaggcucccaagagggagcaguacacacagcccuagcgggcgcccuagaagccgaaauggacggcgccaaaggccgccucuucuccggccaccucaaaugucgccucaagauggacaaacuccgccuaaaaggcguaucuuauagccuaugcacagcagcauucacauucacaaaaguaccagccgaaacgcuccacggaacggucacagucgaaguccaauacgccggcaccgacggaccgugcaagaucccaguacaaauggcaguagacaugcagacccuaacaccagucggccgccugauaacugccaacccagucauaaccgaaucgaccgaaaacucaaagaugaugcuugagcuugacccacccuucggcgacuccuacauuguaaucggcgucggggacaagaaaaucacccaccacuggcacagaagcggauccaccauaggaaaagccuucgaagcaaccguaagaggagccaaaagaauggcaguccucggcgauacagcuugggacuucggaagcgucggaggcgucuucaacucccucgguaaaggcauccaccaaauauucggcgcagcauucaagucccuguucggcggaaugucaugguucucacagauacuaaucggaacacugcuaguauggcuaggccucaacaccaaaaacggcagcaucagccuuacgugccuagcacugggcggagucaugaucuuucucuccaccgccguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7172 - RNA, 2449 nt, Artificial Sequence
  ZIKV (strain NatalRGN) Polyprotein(108-794)(F398S) mRNA Design 2 opt
ggggcgcugccuacggagguggcagccaucuccuucucggcaucaagcuuaccaugacaucaguagggauaguaggacuccuccugacaacagccauggccgccgaagucacaagacguggcagcgcguacuacauguaccuggauagaaacgacgcaggcgaagcaaucaguuuccccacaacacugggcaugaacaagugcuacauccaaaucauggaccugggccacaugugcgaugccaccaugagcuacgaaugccccaugcuagacgaaggcgucgaacccgacgacgucgacugcuggugcaacacaacaaguacgugggucguguacggcacaugucaccacaaaaagggagaagcucggcggucccgccgagccgucacgcuccccagccacagcacaagaaaacuccaaacacgaagccaaacauggcuagaaucaagagaauacaccaaacaccucauaagaguggaaaacuggaucuucagaaacccaggcuucgcacuagccgcagccgcaaucgcgugguuacuuggcuccagcacuucucagaaagucauauaccugguaaugauacuacuaauagccccggcauacucgauacgaugcaucgggguaaguaacagggacuucgucgaaggaauguccggaggcacauggguagacguaguccuagaacacggcggaugcguuacgguaauggcccaagacaaaccaaccguagacaucgaacuggucacaacaaccguaagcaacauggcagaggucagaagcuacugcuacgaagccucaauaagcgacauggcaagcgauucccggugcccaacucaaggggaagcauaccuagacaaacaauccgacacacaauacguaugcaaacgcacacuuguagacagaggcugggggaacggcugcggacuauccggaaaaggcucguuagugacaugugcaaaauucgcaugcagcaagaaaaugacagggaaaucaauacaacccgaaaaccuagaauaucggaucaugcucuccguacacggcucacaacacagcggaaugaucguaaacgacaccggacacgaaacagaugaaaaccgagcuaaaguagaaaucacccccaacagcccaagagcagaagcaacacucggaggauucgguucacuuggacucgacugcgagcccagaaccggccucgacuucucagaccuauacuaccuaacgaugaauaacaaacacuggcucguacacaaagaaugguuccacgacauaccccugccguggcacgcaggggcggacacaggaaccccacacuggaacaacaaagaagcgcuggucgaguucaaagacgcccacgcuaaacgccaaaccguaguaguacucggaagccaggaaggagccguacacaccgcccuggccggggcacucgaagcagaaauggacggcgccaaaggccgccuaagcagcggacaccuaaaaugccgucugaaaauggacaaauugcgacucaagggaguauccuacucccuuugcaccgcagcauucacauucacaaaaauacccgccgaaacacuacauggcacaguaacaguagagguccaauacgcaggcacggacgguccaugcaaaguacccgcgcaaauggccgucgacaugcaaacacugacuccagucggcagacucauaaccgcaaaccccguaauaaccgaaaguaccgaaaacagcaaaaugauguuagagcuagacccacccuucggcgacagcuacauaguaauaggagucggcgagaaaaagauaacccaccacuggcaccgcagcggaagcaccaucggcaaagccuucgaagccacaguccgcggggccaaacgaauggcaguccugggcgacacagcaugggacuucgggucagucggcggcgcacuaaacagccucgggaaaggcauacaccaaaucuucggugcagcuuucaaaagccuauucggugggaugucaugguucagccaaauacucauaggcacccuccucauguggcugggccucaacaccaaaaacggcucaauaagccuaaugugccuagcacuaggcggcguccugauauuccuguccacagccguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7173 - RNA, 2449 nt, Artificial Sequence
  ZIKV (strain ZikaSPH2015) Polyprotein(108-794)(N444Q) mRNA Design 2 opt
ggggcgcugccuacggagguggcagccaucuccuucucggcaucaagcuuaccaugaccagcgucggaauagucggacuccuccucacaacagcaauggccgcggaagucacccgacgcggcagcgcuuacuacauguaccucgaccgaaacgacgccggcgaagccaucagcuuccccaccacccugggcaugaacaaaugcuacauacaaauaauggaccuuggccacaugugcgacgcgaccaugagcuacgaaugccccaugcucgacgaaggaguggagccagacgauguagacuguuggugcaacacaacaucaaccugggucgucuacggcacaugccaccacaagaagggagaagccagacgcagccgcagagcaguaacccuaccgucccacucuaccagaaaacuccaaacacgaagccagacaugguuagaaagccgcgaauacacaaaacaccucaucagagucgagaacuggauauucagaaacccaggcuucgcauuagccgcagccgcaaucgccuggcuccuagggagcucaaccucacaaaaaguaauauaccuagucaugauacuacucauagccccggccuacagcauacgaugcauaggugucucaaacagggacuucgucgaaggcaugagcggaggcacguggguggacauaguacucgaacacggcggcugcgugaccgucauggcacaagacaaaccgacaguagacauagaauuggugacaaccacagucuccaacauggccgaagugcguucauacugcuacgaagcaagcaucagcgacauggccucagacagccgaugcccaacccaaggcgaagccuaccuagacaagcaaagcgacacacaauacgucugcaagcggacgcuaguggaccgaggcuggggcaacggcugcggacuauucggcaaaggaagccucguaacaugcgcgaaauucgcgugcagcaagaaaaugaccggcaaauccauccaacccgaaaaccucgaauacagaauuaugcucuccguacacggcagccaacacuccggcaugauuguacaagauacaggccacgagacagacgaaaacagagcgaaagucgaaauaacccccaacucgccccgggccgaagcaacucuaggaggauucggaucgcuagggcuugacugcgaaccccgaacaggacuagacuucuccgaccuguacuaccuaacaaugaacaacaaacacuggcuaguacacaaagaaugguuccacgacauccccuuacccuggcacgcaggcgccgacacaggaaccccacacuggaacaacaaagaagccuuaguggaguucaaagacgcacacgcaaaacgccaaaccguaguaguacuaggaagccaagaaggagcaguacacacagccuuggccggagcguuagaagccgaaauggacggggcaaaaggcaggcuuagcucgggacacuuaaaaugcagacuaaaaauggacaagcuccgccugaaaggaguauccuacucccuaugcacagccgcguucacauucacgaaaauacccgccgaaacuuuacacggcacggucacagucgagguccaauacgcaggcaccgacgggccaugcaaaguacccgcccaaauggccgucgauaugcaaacccuaaccccaguaggaaggcuuauuaccgccaacccagucauaacagaaagcacagaaaacucaaaaaugaugcuagaacuagauccacccuucggagacuccuacaucgucauaggcguuggagaaaagaaaaucacacaccacuggcacagaucaggaagcaccauaggcaaagccuuugaagcgacaguacgcggcgcaaagagaauggccguacuuggcgacacagccugggacuucggcucagucgggggcgcgcugaacagccuaggcaaagggauacaccaaauauucggagcagcauucaaaucccucuucggcggaaugucaugguucucacaaauccucaucggaacccuacugauguggcuaggccuaaacaccaaaaacggcagcaucucacucaugugccuggcccuaggcggaguccucaucuuccucuccaccgccguaucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7174 - RNA, 2449 nt, Artificial Sequence
  ZIKV (isolate Z1106033) Polyprotein(108-794)(N444Q) mRNA Design 2 opt
ggggcgcugccuacggagguggcagccaucuccuucucggcaucaagcuuaccaugaccagcguaggaaucgucgggcuacuacucacaacagcaauggcggccgaggucacccgcagaggauccgccuacuacauguaccuagaccgaaacgacgcaggcgaagcgaucagcuucccaacuacacuaggaaugaacaaaugcuacauacaaauaauggaccuuggacacacaugcgacgccaccaugagcuacgaaugcccaaugcuggacgagggaguugagcccgacgauguggacugcuggugcaacaccacgagcacguggguugucuauggcacaugccaccacaagaaaggcgaagccagacgcagccgacgcgcaguaacacucccaucacacucaacaagaaaacuucaaacaagaagccaaaccuggcuggaaagccgagaauacacaaaacaccugauacgagucgaaaacuggaucuuccggaaccccggauucgcacucgcggcugcagccaucgccuggcuacucggcuccagcacaucccaaaaagucaucuaccucgugaugauauuauugauugcacccgcauacucaaucagaugcaucggcguaagcaaucgugauuucguggaggggaugucaggcggcaccuggguggacgucguacuagaacacgggggaugcgucacaguuauggcccaagacaaaccaacagucgacaucgaacugguaaccacaaccguaagcaauauggccgaggugcgaucauacuguuacgaggccagcauaagcgacauggcuucagacucccgcugccccacccaaggagaagcguaccuagacaaacaaucagacacacaauacguaugcaaaaggacccuagucgaccgaggauggggcaacggaugcgggcuauucggcaagggcagccuaguaacuugcgccaaauucgcaugcuccaagaaaaugacaggcaaaagcauacaaccagaaaaccuagaauacagaaucaugcuaucgguacacggaagccaacacagcgggaugauaguacaagacacgggacacgaaacagacgaaaacagggccaaaguagagauaacgcccaacaguccccgggcagaagcaacacuaggcggcuucggaucacuaggccuagacugcgaaccacgcacaggccuagacuucagcgaccucuacuaccucaccaugaacaacaaacacuggcugguacauaaagaaugguuccacgacauaccguuaccguggcacgcaggcgcagacaccggcacaccccacuggaacaacaaagaggcccucguagaguuuaaagacgcccacgcaaaacggcaaacagucguaguccuaggaucgcaagagggcgcaguccacacagcacuagcaggcgcccuagaagccgaaauggacggagccaaaggacgacucuccuccggccaccuaaaaugcagacucaagauggauaaacuccgacuaaaaggcgucuccuacucgcucugcacagcggcauuuacauucaccaaaauaccagccgaaaccuuacacggaaccguuaccgucgaaguacaguacgcaggaacagacgggccaugcaaagucccggcacagauggccgucgacaugcaaacccucaccccagucggccgacucaucacggccaaccccgugaucacagaaucgaccgaaaauucaaaaaugaugcuagaacuugacccacccuucggagacagcuacaucgucauaggcgucggcgagaagaaaaucacccaucacuggcaccgcagcggaagcaccauaggaaaggccuucgaggcaaccgugagaggagcgaaacgaauggccguacucggcgacacugcaugggacuucggcuccgucggcggagcucuaaacucccugggaaaaggaauccaccaaauauucggagccgccuucaaaagccuauucggaggaauguccugguucucacaaauacuaauaggcacccuccugauguggcuaggacuaaacgcaaagaacggguccauaagccugaugugccuggcgcucgggggcguccuaaucuuccuauccacagcaguauccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7175 - RNA, 2449 nt, Artificial Sequence
  ZIKV (strain NatalRGN) Polyprotein(108-794)(N444Q) mRNA Design 2 opt
ggggcgcugccuacggagguggcagccaucuccuucucggcaucaagcuuaccaugacaagcguaggaaucgucgggcuccugcuaacgacagcaauggcagcagaagucacucgacgaggcuccgcauacuacauguaccuggaccgaaacgacgccggagaagccauauccuucccaaccacacuuggcaugaacaaaugcuauauccaaauaauggaccucggacacaugugcgaugccacaaugucauacgaaugcccaaugcucgacgaaggcguggaaccagaugacgucgacugcuggugcaacaccacaagcaccugggucguauacgguacaugccaccacaagaaaggcgaagcacggaggagccgacgagcaguaacccuaccaagccacuccacucgcaaacuccaaacccgaagccaaaccuggcuagaaagccgagaauacaccaaacaccuaauacggguagaaaacuggaucuuccgaaaucccggcuucgcacuagccgccgcggcaaucgcauggcucuuaggcucaaguacaagccaaaaaguaaucuaccucgucaugauucuacuaaucgcccccgccuacuccauacgcugcaucggaguaagcaacagagacuucgucgaagggaugucaggcgguaccuggguggacgucguacuagaacacggcggcugcguaaccgucauggcccaagacaaaccaacgguagacaucgaacucgucaccaccacagucagcaacauggccgaagugcgcuccuauugcuaugaagcaucaauaucagacauggcuucagacucacgaugcccaacacaaggagaagccuaccuagacaaacagucagacacccaauacguaugcaaacgaaccuuagucgaucgcggauggggaaacggcugcggccucuucgggaaaggcucgcuagugacaugcgccaaauucgcaugcuccaagaaaaugaccggcaaaucaauccaaccagagaaccuagaguauaggauaaugcucucaguccacggaucgcaacauagcggaaugauaguccaagacacgggacacgagacggacgagaaccgcgcaaaagucgaaauaacaccaaacagcccccgagcggaagcgacacuaggcggguucggaagccuaggacuagacugcgagccacgaacgggccuggacuucucagaccuauacuaccucaccaugaacaacaaacauuggcuaguccacaaagaaugguuccacgacaucccccucccauggcacgcgggugcagacacaggcacuccccacuggaacaacaaagaggcccuggucgaauuuaaagacgcucacgcgaaaaggcaaaccgucguaguacugggcucacaagaaggcgcgguccauacagcccucgcaggcgcauuagaagccgaaauggacggagcaaaaggacgccuauccucaggccaccucaaaugccgacucaaaauggacaaacuacggcugaaaggaguauccuacagccucugcacagccgcauucaccuucaccaaaauccccgccgaaacccuacacgggaccguaacaguagaaguacaauacgcagggacagauggcccaugcaaagucccggcccagauggccgucgacaugcaaacacuaacaccgguuggacgccucaucacagccaaccccgucauuacagaaucaacagagaacuccaaaaugaugcucgaacuagacccacccuucggagauucauacaucgucauaggcgucggagaaaagaaaauaacucaccacuggcaccgcagcggcagcaccaucggcaaagcauucgaagccacaguccgaggagcaaaaaggauggcaguacucggagacaccgcaugggacuuugguagcgucggcggcgcccuaaacucacuaggaaaaggaauacaucaaaucuucggagcagcauuuaaaagccucuucgguggaaugagcugguucucccaaauacuaaucggaacccuccugauguggcuaggacugaacaccaaaaacggaagcaucagccugaugugccucgcgcucgggggcguacuaaucuucuuaagcacagcaguaucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7176 - RNA, 2449 nt, Artificial Sequence
  ZIKV (strain ZikaSPH2015) Polyprotein(108-694)-Cterm-JAEV1-E(400-500) mRNA Design 2 opt
ggggcgcugccuacggagguggcagccaucuccuucucggcaucaagcuuaccaugacaagcguuggaaucgucgggcugcuacucacgaccgccauggccgcugaagucacgcgcaggggcucagcauacuacauguaccucgacagaaacgacgcgggcgaagcaaucagcuucccaacaacacucggcaugaacaaaugcuacauacaaauaauggaccucggacacaugugcgacgcaacaaugucguacgaaugccccaugcucgacgaaggaguugaacccgacgacguagacugcuggugcaacacaacaaguaccugggucguguacggaaccugccaccacaagaaaggagaagcuaggcggucacgacgcgcaguaacccugccaagccacuccacgagaaaacuacaaacccgcagccaaacauggcuggaaucacgcgaauacaccaaacaccucauccgcguggaaaacuggauuuucagaaacccaggcuucgcgcuagccgccgccgccauagcauggcuacucgggucauccacaagccaaaaagucauauaccucgucaugauccuguuaaucgccccagcguacagcauacggugcaucggcgucagcaaucgagacuucguggaaggcauguccggcggaaccugggucgacaucguccucgagcacggagggugcguaaccgucauggcacaagacaaaccaacaguagacauagaacucgugacaacaacaguaucuaauauggccgaaguccgcuccuacugcuacgaagccagcaucucagacauggccuccgacucacgcugcccaacgcaaggggaagcauaccucgacaaacaauccgacacccaauacguaugcaaaagaacacucguagaccgaggguggggaaacggaugcggccuauucggaaaaggcagccucguaaccugcgccaaauucgcgugcuccaagaaaaugacgggcaaaagcauccaacccgaaaaccucgaauacagaaucaugcuguccguccacggcucccaacacuccgggaugaucguaaacgacacgggacacgaaaccgacgaaaaccgagccaaaguagaaaucaccccaaacagucccagagccgaagccaccuugggugguuucggaagccucggccucgacugcgaaccgagaacaggccuggacuucagcgaccucuacuaccucacaaugaacaacaaacacugguuaguccauaaagaaugguuccacgacauaccucuccccuggcacgccggcgcagacaccggaaccccacacuggaacaacaaagaggcacuuguagaguucaaagacgcccacgccaaacgacaaaccgucguaguccucggaucacaagaaggcgcgguacacaccgcacucgcgggggcccuggaagcagaaauggacggcgccaagggcagacucagcuccgggcaccucaaaugcagacugaaaauggacaagcuccgacucaagggagucucuuacucacuaugcaccgccgcguucacauucacuaaaaucccagccgaaacacuccacgguaccgucaccguagaaguccaguaugcaggcacugacggcccgugcaaagugcccgcccaaauggccguagacaugcaaacacucaccccaguaggaaggcuaaucacugcaaaccccgugauaacagaaucaaccgaaaacucaaaaaugaugcuagaacuagacccacccuucggagacuccuacaucgucauaggagugggggaaaagaaaaucacacaccacuggcacagguccggcuccacacucggcaaagccuucuccaccacccuaaaaggcgcacaacgccuagcagcccuaggagacacggcgugggacuucggguccauaggcggcguauucaacuccaucggacgcgcaguccaccaagucuucggcggagccuuccgaacccuauucggcggaaugagcuggauaacccagggacugaugggagcacuacugcuauggaugggcgucaacgcacgcgacagaagcauagcacuagccuuccucgccacuggcggaguacucguauuccuggcaacaaacguccacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7177 - RNA, 2449 nt, Artificial Sequence
  ZIKV (isolate Z1106033) Polyprotein(108-694)-Cterm-JAEV1-E(400-500) mRNA Design 2 opt
ggggcgcugccuacggagguggcagccaucuccuucucggcaucaagcuuaccaugaccagcgucggaaucgucggacuccugcuaacaacagcaauggcagccgaagucacgcgaaggggaucggcauacuacauguaucucgaccgcaacgacgcgggcgaagccaucagcuucccaacaacgcugggcaugaacaaaugcuacauacaaauuauggaccuaggacacacaugcgacgcaacaaugagcuacgaaugccccaugcucgacgagggcguugaacccgacgacgucgacugcugguguaauacgacauccacauggguaguauacgggaccugccaccacaagaaaggggaagcgcgccgguccaggagggccgucacucucccgagccacaguaccaggaaacuacaaacccgcagccaaaccuggcucgaaagccgugaauauacaaaacaccuaauucgcguagagaacuggaucuuccgcaaccccggauucgcccuggcagcagcagcaauagccuggcuguugggcucaagcacaagccaaaaggucauauaccugguaaugauccuacuaauagcaccagcauacuccaucagaugcauaggcgugagcaaccgagacuucguugaaggaaugucgggcgggacaugggucgacguaguccuagaacacggaggcugcguaacggucauggcucaagacaagcccacggucgacauagagcuaguuacuacaacaguaagcaacauggccgaagucaggagcuauugcuacgaagccuccaucucagacauggcauccgacucccggugccccacccaaggagaagcauaccucgacaaacaaagcgacacgcaauacgucugcaaaaggacccucgucgaccgcggauggggcaacggaugcgggcuauucggaaaaggaucccucgugaccugcgccaaauucgccugcuccaagaaaaugacaggcaaaagcauacaacccgagaaucuggaauacagaauuaugcucagcguacacggcucacagcacagcggcaugaucguaaacgacaccggacacgaaacggacgaaaaccgagcaaaagucgaaauaacaccaaacagcccucgcgcggaagcgacccugggaggauucgggagccuaggacuggacugcgaaccccgcacgggccuagacuucagcgaucucuauuaccuaaccaugaacaacaaacacuggcuagugcacaaagagugguuccacgacaucccacucccguggcacgccggagccgacacaggaaccccgcacuggaacaacaaagaggcccuuguagaguucaaagacgcacaugcgaaaagacaaacagucguaguccugggcucacaagaaggagccguacacacagcacuagcaggcgcucucgaagccgaaauggacggagccaaagggcgccuaagcuccggccaccugaaaugccgccuaaaaauggacaaacuacgccucaagggaguaucauauucccuaugcaccgcagccuucacauucacaaaaaucccagccgaaacacuacacggcacaguaacagucgaaguacaauacgcaggaacagacggcccaugcaaaguccccgcccaaauggcgguugacaugcaaacccuaaccccagucggacgccugaucacagcaaacccagucaucaccgaauccacagagaacucaaaaaugaugcucgaacuagacccgcccuucggcgauagcuacaucguaauagggguaggagaaaagaaaaucacacaucacuggcaccgcagcggaagcacccuaggcaaagcauucucgaccacacugaaaggagcacaacggcucgcagcccucggagacaccgccugggacuucggauccauagggggagucuucaacucgaucggccgcgcaguacaucaaguauucggcggcgcguucaggacacuauucggaggaaugagcuggaucacacaaggccuaaugggagcccuacuacucuggaugggcgucaacgcacgagaccggagcauagcccuagcauuccucgccaccggaggcguacucguauuccuagcaacgaacguacacgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7178 - RNA, 2437 nt, Artificial Sequence
  ZIKV (strain MR 766) Polyprotein(108-690)-Cterm-JAEV1-E(400-500) mRNA Design 2 opt
ggggcgcugccuacggagguggcagccaucuccuucucggcaucaagcuuaccaugaccagcaucggaauaaucggacuccuccuaacgaccgcaauggcagcagaaauaacacgacgaggcucagccuacuacauguaccuggaccgcagugacgcaggaaaagcgaucucguucgcaacuacccucggcgucaacaaaugccacguccaaaucauggaccucggucacaugugcgacgcaaccauguccuacgaaugcccaauguuagaugaagguguagaaccagacgacguagacugcuggugcaacacgacgucaaccugggucgucuacgguaccugccaucacaagaaaggcgaagcccgccgcagcagacgcgccguaacccuaccaagccacucaacacgaaaacuccagaccagaucacagacguggcuggaaucccgagaauauaccaaacaccuaauaaaagucgaaaacuggauauucagaaaucccggauucgcccucgucgcaguagcaaucgcuuggcuacucggauccagcacaagccaaaaaguaaucuaucucguaaugauacuccuaauagcacccgcauacuccauaagaugcaucggcguaagcaaccgagacuucgucgaaggaaugucgggcggcacauggguagacgugguacuagagcacggaggauguguaacggucauggcacaagauaaaccgaccgucgacauagaacucguaacaaccaccguauccaacauggccgaagucagaagcuacuguuacgaagccuccaucucagacauggccucagacucccgcugccccacacagggcgaagcauaccuagacaagcaauccgacacacaauaugucugcaaacgaacgcuagucgaccgaggaugggggaacggaugcggacucuuugguaagggcucacucguaaccugcgccaaauuuaccugcagcaagaaaaugaccggaaaaagcauccaaccggaaaaccuagaauacagaauuaugcucucgguccacggcucacaacacagcgggaugauaggcuaugaaaccgacgaagacagagccaaaguagaggucacaccaaacagccccagggcagaagcaacccucggcggcuucggaucccucggccucgacugugaaccccgaaccggccuggacuucuccgaccucuacuaccugaccaugaacaacaagcacugguuaguucacaaagaaugguuccaugacaucccccuacccuggcacgccggcgcagacaccggcaccccacacuggaacaacaaagaagcccuagucgaguucaaagacgcacacgccaaacggcaaacagucguaguccuuggcucccaagaaggagccguacacaccgcacucgccggagcacuagaagcagaaauggacggugccaagggccgacucuucagcggacaccuaaaaugccgccucaagauggacaagcuaagacucaaaggggucuccuacucucucugcacugcagccuucaccuucacgaaaguccccgcagaaacccuccacgggacugucaccguagaaguacaauacgccgguaccgacggcccaugcaaaaucccaguacaaauggcaguagacaugcagacacuuacacccguaggacgccuaauaacagcaaaccccgucauaaccgaaagcacagaaaacuccaaaaugaugcuagaacuagacccucccuucggagacagcuacauagugaucggcgucggcgacaagaaaaucacacaccacuggcacagaagcggcagcacccuaggcaaagcauucucuacaacccucaaaggcgcccaacgacuagcagcacucggagacacagccugggacuucggaagcaucggaggcgucuucaacagcauaggacgcgccguacaccaagucuucggaggcgcuuuccgcacccucuucggcggaaugagcuggaucacccaagggcugaugggcgcacuacuacucuggaugggaguaaacgcacgggacagaagcaucgcccuggcuuuucucgccaccggcggcguccucgucuuccuagcaacgaacguacaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7179 - RNA, 2449 nt, Artificial Sequence
  ZIKV (strain NatalRGN) Polyprotein(108-694)-Cterm-JAEV1-E(400-500) mRNA Design 2 opt
ggggcgcugccuacggagguggcagccaucuccuucucggcaucaagcuuaccaugaccuccgucggcauaguaggccuacuacucaccaccgccauggccgccgaagucacgcgcagaggaagcgcauacuacauguaccuggaccgaaacgaugccggcgaagcgaucuccuucccaaccacucucgggaugaacaaaugcuauauccaaaucauggaccuaggacacaugugcgaugcaaccauguccuacgagugcccaaugcuagaugaaggagucgaaccagacgacguggacugcuggugcaacaccaccucgacauggguagucuacggcacaugccaccauaagaagggggaagccagacgcuccagacgagcaguaacgcuccccucacacucaacgagaaaacuccaaaccagaagccagacauggcucgaaucacgcgaguacaccaaacaccucauccgcgucgaaaacuggaucuuccgaaauccuggcuucgcccuagcagcagccgccauagccuggcuacucggcagcagcaccagccaaaaaguaaucuaucuaguaaugauccuacuaaucgcacccgccuacagcauacgcuguaucgguguaucaaaccgcgacuuugucgaaggaaugucaggcggcacaugggucgacguaguccuagaacacggcggcugcgucacaguaauggcacaagacaaaccaacggucgacauagagcuaguaacaacaacgguauccaacauggccgaaguccgaucauacugcuacgaagccuccaucucagacauggcaucggacucccgcuguccgacacaaggagaagcguaccuagacaaacaaucggacacccaauacguaugcaaacgaacucuaguagaccgcggcuggggaaacggauguggccucuucgguaagggcucacucgugaccugcgcaaaauucgcaugcagcaagaaaaugaccggcaaauccauccaaccugaaaaccuagaauaccgaauaaugcuaucaguccacgguucacaacacuccggaaugaucguaaacgacaccggccacgaaacagacgaaaaccgagccaaaguagaaauaacccccaacagcccacgagcggaagcaacccuagggggauucggcucacuggggcuggacugugaacccagaacgggccuagacuucagcgaccucuacuaccuaacaaugaacaauaaacacuggcuaguacacaaagaaugguuccacgacaucccccuccccuggcacgcaggcgccgauaccggcacuccccacuggaacaacaaagaagcucuggucgaguucaaagaugcacacgcuaaaagacaaaccguagucguccuaggcucccaggaaggugcgguccacaccgcccucgcaggagcccucgaggcagaaauggacggcgcuaaaggacgccuaagcuccggccaccucaaaugccgccuaaaaauggacaaguuacgccucaaaggagugaguuacagccucugcacagcggccuucaccuucacaaaaaucccagcagaaacacuacacggaaccgucaccgucgagguucaauacgcaggcacggacgggccaugcaaagucccagcccaaauggccgucgacaugcaaacucuaaccccaguaggccgccucauuacagccaacccaguaaucacugaauccaccgagaacagcaaaaugaugcucgaacucgacccaccauucggggacuccuacaucgucaucggcguaggcgagaagaaaauaacacaccacuggcaccgcucggggagcacucucggcaaggccuucucaaccacacucaaaggcgcccaacgacucgccgcccuaggagacaccgcaugggacuucggcucaaucggcggagucuucaacagcauaggccgcgccguacaccaaguauucggcggagcauuccgcacacuguucgggggaauguccuggauaacacaaggccucaugggcgcccuauuacuuuggauggggguaaacgcccgagaccgaagcauagcccuagccuuccuagccaccggagggguacucguauuuuuagccaccaacguccacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7180 - RNA, 2524 nt, Artificial Sequence
  ZIKV (strain ZikaSPH2015) Polyprotein(93-804) mRNA Design 2 opt
ggggcgcugccuacggagguggcagccaucuccuucucggcaucaagcuuaccaugcgcaucauaaacgcccgcaaggaaaagaaaagacgcggggccgacacauccgucggaauaguaggccugcuacuaacaaccgccauggccgccgagguaacaagacgcggcagcgccuauuacauguaccucgaccgcaaugacgcaggagaagcaauaucauuccccaccaccuugggaaugaacaaauguuacauccaaaucauggaccuaggacacaugugcgacgcaacaaugaguuacgagugcccaaugcuggacgaaggaguggaaccagacgacgucgacuguuggugcaacaccaccagcaccuggguaguauacggcacaugccaccacaagaaaggcgaagcacgacgaagccggagagcgguaacccuccccagccacuccacacgcaaacugcaaaccagaucccaaaccuggcuagaaagccgcgaauacacaaaacaucucauacgcguggaaaacuggauauuuagaaacccaggcuucgcccuagccgccgccgcaaucgcauggcuccucggaagcuccaccagccaaaaaguuauuuaccugguaaugauacuguugauagcacccgccuacagcauucgguguaucggcguaagcaacagagacuucgucgaaggaaugucgggaggcaccugggucgacaucguccuagagcacggcggcugcguaaccgucauggcacaagacaaaccaacagucgacaucgagcucgucaccaccaccguaucaaacauggccgaagugcgcagcuacugcuacgaagcaagcauaucagacauggcuucugacagcagaugccccacacaaggagaggccuaccuagacaagcaauccgacacacaguacguaugcaaacgaacccuagucgaccgaggauggggaaacggaugcggauuauucggcaagggaucccuagucacgugcgcaaaauucgccugcagcaagaaaaugaccggaaaauccauacaaccagaaaaccucgaauacaggauaaugcucagcguacacggcucacaacacaguggcaugaucgucaacgacaccggacaugaaaccgacgaaaaccgcgccaaaguggaaaucaccccaaacagcccacgggcagaggcaacacucggcggcuucggcucccuaggacuggacugcgaacccagaaccggacucgacuucuccgaccucuacuaccuaacaaugaacaacaaacauuggcuggugcacaaagaaugguuccacgacauaccgcuucccuggcacgccggcgccgacacgggaacaccccacuggaacaacaaagaagcccucguagaguucaaagacgcacacgcaaaacgacaaacggucgucguccuagggucacaagaaggcgccguccacaccgcacuagccggcgcacucgaagcagaaauggacggcgccaaaggacgacucucaucaggccaccuaaaaugccgccuaaaaauggacaaacuacgccugaaaggcgucagcuacagccuauguaccgccgcauuuacguuuaccaaaauacccgcagaaacacuccacggcacagucacagucgaaguccaauacgccgggaccgacggccccugcaaaguaccggcccagauggcaguggacaugcaaacgcucaccccaguuggaagacugauaaccgcaaaccccgucaucaccgagagcaccgaaaacucaaaaaugaugcuagaacucgacccacccuucggcgacuccuacaucgucaucggcgucggugaaaagaaaauaacacaucauuggcacagauccggaagcaccaucggaaaagcauucgaagccaccguccgaggagcaaaaagaauggcgguccucggcgacaccgcgugggacuucggaagcgugggcggcgcccucaacagccuagggaaagggauacaccaaauuuucggugcagccuucaaaucacuauucggcggaaugagcugguucucccaaauacuaaucgguacacuacucauguggcuaggccuaaacaccaaaaacggcagcauaagccuaaugugucucgcucuaggcggcguacucaucuuccucucuacagcagucagcgccgacguaggcugcagcgucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7181 - RNA, 2521 nt, Artificial Sequence
  ZIKV prME variant mRNA Design 2 opt
ggggcgcugccuacggagguggcagccaucuccuucucggcaucaagcuuaccaugaucaucaaugcucgaaaagagaagaaacgacguggcgcagacacaucggucggcauaguaggacucuuacucacaaccgcaauggcagcggaagucacccgacgcgggagcgccuacuacauguaccucgaccgcaacgaugccggugaggcaaucucauuccccacgacacuaggaaugaacaaaugcuacauccaaaucauggaccucgggcacaugugcgaugcgacuauguccuaugagugcccaaugcuggaugaaggagucgaacccgacgacguagacugcuggugcaacacgaccaguacaugggucguauacggaacgugccaccacaagaaaggcgaagcccgccgcagccgucgagcagugacccuacccagccacucaacacgcaaacuccaaacacguucacaaaccuggcucgaaagccgagaauacacgaaacaccuaauaagagucgaaaacuggaucuuuaggaacccgggcuucgcacuagcagcggccgcgauagccuggcuccuggggagcucgaccucacaaaaagucauauaccugguaaugauccuacugaucgccccggcauacucuauacgcuguauaggcgucucgaaccgcgacuucguagaaggaaugagcggagggacaugggucgacauaguccuagaacacgggggcugcguaacagucauggcccaagacaaaccaaccgucgacaucgaauuagucacaacuacagucucgaacauggccgaaguacggagcuacugcuacgaagccagcaucagcgacauggccucagacagccgaugcccaacacaaggcgaagcauaccucgacaaacaaagcgacacacaguacguaugcaaacgcacccuaguagacagaggauggggaaacgguugcggacucuucgggaaaggaagccuagucacaugcgcaaaauucgccugcagcaagaaaaugacuggcaaaaguauacaaccagaaaaccucgaauaccgaaucaugcucagcgugcacggaucacaacacucugggaugauaguaaacgacaccggacaugaaaccgaugaaaaccgcgccaaaguagagaucacaccaaacagccccagggccgaagccacccucggaggcuucggcagccugggacuagacugcgaaccccgcacaggccucgacuucucagaucuauacuaccucacaaugaacaacaaacacuggcuaguccacaaagaaugguuccacgacaucccucuaccguggcacgccggcgcagacaccggcaccccacacuggaacaacaaagaagcccuaguggaguucaaagacgcacacgcaaagcgccagacaguaguaguacuagggagccaagaaggagcaguccacacagcacucgccggggcccuagaagccgaaauggacggcgcaaagggacgccuguccucgggacaccuaaaaugccgacugaaaauggacaagcuccgacuaaaaggcguaagcuacagucuaugcacagccgcguucacauucaccaaaaucccugcagagacgcugcacgggaccguaacaguagaaguacaauacgccggcacggacgggcccugcaaaguaccagcacaaauggccgucgacaugcagacacucacacccguaggcagacuaaucacagcaaaccccguaaucaccgagucgacagaaaacaguaagaugaugcuggaacucgacccacccuucggagacuccuacauaguaauaggcgugggugaaaagaaaaucacacaccacuggcaccgaagcggaagcacaauaggcaaagccuucgaagcaacaguaagaggggcaaaacgcauggccguccucggcgacacagcgugggacuucggaagcgucggaggcgcacucaacucccucggaaaaggaauccaccaaauauucggagcagccuucaaaucccuauucggcgggaugaguugguucagccaaauacugauaggcacccugcuaauguggcuaggacucaacaccaaaaacgggucaauaucacucaugugccucgcgcuaggaggagucuuaaucuuccuaucaacagcugucagcgccgauguaggaugcuccguugacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7182 - RNA, 2518 nt, Artificial Sequence
  ZIKV prME variant mRNA Design 2 opt
ggggcgcugccuacggagguggcagccaucuccuucucggcaucaagcuuaccaugaucaacgcaaggaaggagaagaaacgccgaggggccgacacgagcgugggcauagucggccuccuacucacaaccgcgauggcggcagagguaacaagaagaggcagcgccuacuacauguaccucgaccgcaacgacgcaggagaagcaauaucauucccaaccacccuaggcaugaacaaauguuacauacaaaucauggaccuaggccacaugugcgacgccacaauguccuacgaaugcccaaugcuagacgagggcguagagcccgacgacgucgacugcuggugcaacaccacuagcaccugggugguauauggcacuugccaucacaagaaaggagaagcccgccgcuccaggagagcaguaacccuccccagccacagcacaagaaaacuccaaacaagaucccaaacuuggcuggaaucgagagaauacaccaaacaucuaauaagagucgagaacuggaucuuccgaaacccaggauucgcacuagccgcagcagcaauagccuggcuucuaggcucaagcacaucccagaaaguaaucuaccuagucaugauacucuugauagcaccagcauacucaauccgcugcauaggaguaagcaaccgcgacuucgucgaaggaaugagcggaggcacaugggucgauaucguacucgagcacggaggcugcguuacggucauggcacaagacaaacccaccguagacaucgaacugguaaccacaacagugagcaacauggcagaaguacgcagcuacuguuacgaagcaucaaucucagacauggcaucagacagccgaugcccaacacaaggcgaagcguaccucgacaaacaaagcgacacacaauacguauguaaacggacccuggucgaccgaggauggggcaacggaugcggacuguucggcaaaggaucgcucguaacaugcgcaaaauucgcaugcagcaagaaaaugaccggaaaaagcauacaacccgagaaccucgaauaccggaucaugcucucgguacacgggucccaacacagcggcaugauaguaaacgacacgggacacgaaacagacgagaacagagcgaaagucgaaauaacaccaaacagcccccgagcagaagcgacccugggcggcuucgggucccugggacuagacugcgaaccaagaacuggacuagacuuuuccgaccuauacuaccuaaccaugaacaacaaacacuggcugguacacaaagaaugguuccaugacaucccgcucccauggcacgccggggccgauaccggcacaccccacuggaacaacaaagaagcccuagucgaauuuaaagacgcccaugccaaaagacaaacagucgucguacugggcagccaagagggcgccguacacaccgcgcucgcaggcgcacuagaagccgaaauggacggagcaaaaggaagacuaagcucaggccaccuaaaaugcagacucaaaauggacaaacugcgccugaaaggagugucguacucccuaugcacagcagccuucaccuucacaaaaaucccagcagagacgcuacacgggacagucaccguagaggugcaauaugcagggacagacggcccaugcaaaguacccgcccaaauggccguagacaugcaaacccuaacaccagucggacgccucauaacagcaaacccaguaauaacagaaucuacggagaacucgaaaaugaugcuggaacuagauccgcccuucggcgacagcuacaucguaauaggagucggugaaaagaaaauaacacaccacuggcacagauccggcagcacgauaggaaaagccuucgaggcaacaguaaggggcgccaaacgaauggcaguacuaggcgacaccgccugggacuucgggucagucggaggggcacuaaacagucucgggaaaggcauacaccaaauuuucggagccgccuucaaaagccuauucggaggaaugucgugguucucacaaauccuuauaggcacgcuacuaauguggcuugggcuaaauaccaaaaacggcagcaucagccugaugugccuagcacucggaggcgugcucauauuccucagcaccgccgucagcgcggacgucggaugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7183 - RNA, 2515 nt, Artificial Sequence
  ZIKV prME variant mRNA Design 2 opt
ggggcgcugccuacggagguggcagccaucuccuucucggcaucaagcuuaccaugaacgcgcgaaaagaaaagaaaaggcgaggggccgacacaagcguuggaaucgucggccuacucuugacaacggcaauggcagcagaaguaacacggcgcggaucagcguacuacauguaccucgacagaaacgacgccggcgaagccaucagcuuccccacgacccucggcaugaacaaaugcuauauacaaaucauggaccucggccacaugugcgacgcaacaaugagcuacgaauguccaaugcucgacgaaggggucgaaccagacgacguagacuguuggugcaacacaacgagcacauggguaguauacggaacaugccaccacaagaaaggcgaagccagacgcagccgaagggcaguaacacuccccagccacucaacacgcaaacuccaaacccgaucacaaacguggcuagaaucccgugaauacaccaaacaccuuauacgcgucgaaaacuggaucuuccgcaauccaggguucgcacucgccgcagcagccaucgcguggcugcuaggauccagcacaucgcaaaaaguaaucuaccuaguaaugauccuccuaauugccccggcguacucaauccgaugcauaggagucucaaaccgggacuucguagaaggcaugagcggaggcacauggguagacauuguccuagaacacggcgggugugucaccgucauggcccaagacaagccaaccguggacaucgaacucgucacaacaaccguaucuaacauggcagagguaagaucauacugcuacgaagccaguauauccgacauggcaagcgauuccagaugcccaacccaaggcgaagccuaccuagauaaacaaucagacacccaauacguaugcaaacgcaccuuagucgaccgaggcuggggcaauggaugcggccucuucgggaaaggaagccuagucacuugugcgaaauucgccugcagcaagaagaugacaggcaaauccauccagcccgaaaaccucgaauaccgaaucaugcuaagcguacacggcagccaacacucuggaaugauagucaacgacacugggcacgaaacagacgaaaaccgcgcgaaaguggaaaucaccccaaacucacccagagccgaagccacacuaggaggcuucgguucacucggacucgacugcgaaccaagaaccggccuugacuucucagaccuauauuaucuaacaaugaacaacaagcacuggcuggugcacaaagaaugguuccacgacauaccucucccguggcacgcaggcgcagacacaggaacaccacacuggaacaacaaagaagcccuagucgaguucaaagacgcacacgccaaacgacagacuguagucgugcuaggaagccaagaaggagccgugcacacugcccucgcaggggcacuagaagcagaaauggacggagccaaaggaagacuaagcagcggacaccugaaaugcagacuaaaaauggacaaacuaaggcucaaaggagucaguuacucacuaugcacagccgcguucacauucacaaaaauacccgcagaaacgcuccacggaacagucacaguugaaguccaauacgcaggcacagacggccccugcaaagugcccgcccaaauggcaguagacaugcaaacacucacgcccguagggagacuaauaacggcaaacccggucauaaccgaaagcaccgaaaacagcaaaaugaugcucgaacucgauccgccguucggcgauagcuacaucgucauaggagucggcgaaaagaaaaucacacaccacuggcacagauccggauccacaaucggaaaagccuucgaagccacagugcgaggagccaaacguauggcgguacucggcgacacggccugggacuucggcagcgucgggggagcacugaacagccuaggaaagggaauccaccaaaucuucggagccgccuuuaaaagucucuucgggggcaugucaugguucagucaaauacucaucggaacacuacucauguggcuaggccuaaacaccaaaaacggauccauaucacuaaugugccuugcccuaggcggaguccuaauauuccucucaacagcagucagcgccgacgucgggugcucggucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7184 - RNA, 2512 nt, Artificial Sequence
  ZIKV prME variant mRNA Design 2 opt
ggggcgcugccuacggagguggcagccaucuccuucucggcaucaagcuuaccauggccagaaaagagaaaaagagacgaggagcggacacguccgucggcaucgucggucuccuucugacaaccgccauggccgcggagguaacccgccgcggaagcgccuacuauauguaccucgacagaaacgacgccggagaagcaaucucauuccccacaacccuaggaaugaacaaaugcuacauccaaaucauggaccucggccacaugugcgacgccacaaugagcuacgagugccccaugcuagacgaaggaguagagcccgacgacgucgacugcuggugcaacaccaccucaaccuggguagucuacggaacaugccaccacaagaaaggcgaggcaagacgcucccgccgagccguuacgcuuccgucacacagcaccagaaaacuccaaaccagaucccagaccuggcucgaauccagagaauacacuaaacaccuuauacgagucgagaacuggaucuucaggaacccaggcuucgcguuagcagcagccgcgaucgccuggcuacucggcaguuccaccagccaaaaaguaauuuaccucgugaugauccuacuaaucgcaccggcauauucuauaagaugcauaggcgucagcaacagggacuucguggaaggaaugucaggaggcaccugggucgauaucguacuagaacacggaggcugcgucaccgucauggcccaagacaaaccaacggucgacaucgaauuagucaccacaaccguaagcaacauggcagaagucagaagcuacugcuacgaagcauccaucuccgacauggcaagcgacucacgcugccccacccaaggcgaagcauaccucgauaaacaaagcgacacacaauacguaugcaaaaggacacucguggacagaggaugggggaacggcugcggccuauucggcaaaggaagccucgugaccugcgccaaauucgcaugcuccaagaaaaugaccggaaaaucaauccaaccagaaaaucucgaauacagaaucaugcucuccguccacgggucccaacacagcggcaugauaguuaacgacacaggccaugagaccgacgaaaaccgggcuaaaguagagauaacccccaacucaccccgggccgaagccacgcuagggggcuucggaagccuaggacucgacugugaaccgcguacgggacucgacuucuccgaccuguauuaucucacaaugaacaacaaacacuggcuaguacacaaagagugguuccacgacauaccgcuaccauggcacgccggcgccgacaccggaacaccacacuggaauaacaaagaagcccucguagaguucaaagacgcgcacgcaaaaagacaaaccgugguagucuuaggcucacaggaaggggcaguacacacagcccuggcaggagcacuagaagccgaaauggauggagcaaaagggcgacuaagcagcgggcaccuuaaaugccgacucaaaauggacaaacuacgccucaaaggagucuccuacucgcuauguaccgccgcauuuacauucaccaaaauccccgcagaaacccuccacggaacaguaacaguagaaguccaauaugccggcacagauggcccaugcaaaguaccugcgcaaauggcagucgacaugcaaacacuaacgccugucggccgacuaaucacagccaacccaguaaucacagaaucgaccgaaaacagcaagaugaugcuagaacuagacccacccuucggcgacuccuacauagucauagggguaggagaaaagaaaaucacucaccacuggcacaggagcggcuccaccauaggaaaagcguucgaagcuaccgucagaggcgcaaaacgcauggcgguacugggagacaccgcaugggacuucggaagcgucggaggggcccuaaacucccuaggaaaaggaauccaccaaauauucggagccgccuucaaaagccuauucggaggcaugagcugguuuucccaaauacuaaucggcacccuccucaugugguuaggacuaaacaccaaaaacggcagcauaucacucaugugccucgcgcuaggcggcguccucauauuccucagcacagcagugucggccgacgucggcugcagcguagacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7185 - RNA, 2509 nt, Artificial Sequence
  ZIKV prME variant mRNA Design 2 opt
ggggcgcugccuacggagguggcagccaucuccuucucggcaucaagcuuaccaugagaaaagagaagaaacgaagaggagcagacaccagcguaggaauagucggacuccuccuaacuaccgcaauggcagcagaagucacgcgaagaggcagcgcguacuacauguaccuagaccggaacgaugccggcgaggccaucucauucccaacaacacucgggaugaacaaaugcuacauacagaucauggaccucgggcacaugugcgacgccacuauguccuacgagugcccgaugcuggacgaaggcgucgagccagacgacgucgacuguugguguaacacuaccagcaccuggguaguauacggaacaugccaccacaagaaaggagaagcccgcaggagcagacgcgcggucacgcugccaucccacagcacgcgcaaacuccaaacuaggucacaaaccuggcuagagagccgagaauacaccaagcaccuaaucagagucgaaaacuggauauuccgcaacccaggauuugcacuagcggccgccgcaauagcguggcuacuaggcucgagcacaucccaaaaagugaucuaccuagucaugauacuccuaaucgcacccgcauacagcauccgaugcauaggagucucuaacagagauuucgucgaaggaaugucgggcggaacgugggucgacauaguacuagaacacggaggcugcguaaccgugauggcccaagacaaaccaaccgucgacaucgagcuagucacgacuaccguaagcaacauggcagaaguacgauccuacugcuacgaagcaagcaucucagacauggccagcgacagccgaugccccacccagggcgaagcauaccuagacaaacaaucagacacacaauacgucugcaaaagaacacucguagaucgcggauggggcaacggaugcggacucuucggaaaaggcagucuagucacaugcgccaaauucgcaugcucaaagaaaaugaccgguaaauccauacaaccagaaaaccucgaauaccggauaaugcucucaguacaugggagccaacacagcggcaugauagucaacgacacagggcacgaaacugacgaaaaccgcgccaaaguagaaauaacaccaaacagcccccgcgccgaagccacacugggaggcuuuggaagccucggcuuagauugcgagccacgaacaggccuagacuucucggaccuauacuaccucacgaugaacaacaaacacuggcuaguacauaaagaaugguuccaugacaucccccucccauggcacgcuggcgcggacacggggacaccacacuggaacaacaaggaagcccugguagaguucaaggacgcccacgcgaaaaggcaaacagucgugguauuaggcagccaggaaggcgccguccacaccgcauuagccggcgcccuggaagccgaaauggacggagcaaaaggcagauuaagcuccggacaccucaaaugccggcuaaagauggacaaacucagauugaaaggaguauccuacagccuuugcaccgcagccuucaccuucacgaaaauaccagccgaaacacuacacggaacaguaacggucgaagugcaauacgcaggaacagacggccccugcaaaguaccagcgcaaauggcagucgacaugcaaacccugacgccggucggcagacuaaucaccgcaaacccagucaucacagaauccaccgaaaacucaaaaaugaugcuagaacuggacccacccuucggagacuccuacauuguaauaggagucggcgaaaagaaaauaacccaccacuggcaccgaucaggcagcacaauaggcaaagcauucgaagccaccguaagaggcgcaaaacgcauggcaguacugggagacaccgcaugggacuucggcagcguuggcggagcccucaacuccuuaggcaaaggaauccaccaaauauucggagcagcauucaaaagccuguuuggcgguaugagcugguucucccaaauacucaucgggacacugcugauguggcucggacucaacacgaaaaacgguagcauaagucugaugugccucgcccuaggcggcguacucaucuuccuaaguacagcgguaucagcagacguaggcugcagcgucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7186 - RNA, 2506 nt, Artificial Sequence
  ZIKV prME variant mRNA Design 2 opt
ggggcgcugccuacggagguggcagccaucuccuucucggcaucaagcuuaccaugaaagaaaagaaacgccgaggcgcagacaccaguguaggcauaguaggacuucuccuaacaacagccauggcggcggaaguaacucgcagaggcuccgccuacuacauguaucucgaccgaaacgacgcgggugaagcaaucagcuucccaaccacucucggcaugaacaaaugcuacauccaaaucauggaccucggccacaugugcgacgccacaaugagcuaugaaugccccaugcuagacgaaggcguagaacccgacgacguagacugcugguguaacaccaccucaaccugggucgucuacggaacgugccaccauaagaaaggagaagcacgccgcagcagacgcgcggucacauuaccaagccauagcacgcgcaaacuacaaacccggucacagacauggcucgagagccgagaguacaccaaacaccuaauacgcgucgaaaacuggauauuccgaaaccccggauucgcacuugcagcggccgccaucgcauggcuccugggcucaagcaccagccaaaaaguaaucuaccuagucaugauccugcuaaucgccccagccuacagcaucaggugcauaggcgugagcaaccgagacuucgucgaaggaaugucgggcggaaccuggguagacaucguacuggaacauggcggcugcgucaccguaauggcccaagacaagcccaccgucgacauagaacucgucacaacuaccgucuccaacauggccgagguacgcuccuacugcuacgaagccucaaucuccgacauggccagcgacucacgaugcccuacgcaaggcgaagccuaccuggacaaacaaucggacacacaauacgugugcaaacgaacauuagucgaccgaggaugggggaacggcugcggccuguucggcaaaggcucauuagugaccugcgcaaaguuugccugcagcaaaaagaugaccggaaaauccauacaaccagaaaaccuagaauacagaaucaugcugucaguacauggcucacaacacagugguaugaucgucaacgacacgggccacgaaacagacgaaaaccgagcgaaaguagaaaucaccccaaacagcccgcgcgcugaagccacacucggagguuucggcucacuaggccuagacugcgagccacgaacuggccuugacuucuccgaccuguacuaccucaccaugaauaacaaacacuggcuaguacacaaagaaugguuccacgacaucccacuacccuggcacgccggcgccgacaccgggaccccacacuggaacaacaaagaagcacugguagaguucaaagacgcccacgccaaaagacaaaccgucguaguacuaggcagccaagaaggugcgguccacaccgcccuagccggcgcccuagaagccgaaauggacggugccaaaggccgccuuagcuccggucaccuaaaaugccgacuaaaaauggacaaacugagacuaaaaggcgucucauacucauuaugcacagcagccuuuacuuucacaaagaucccagccgagacgcuacacggaacaguaacaguagaaguacaguacgccgggaccgacggccccugcaaaguccccgcccaaauggccguagacaugcagacacuaaccccagucgggagacugaucaccgccaacccgguaauaacagaaagcaccgaaaacuccaaaaugaugcuugagcuagacccaccuuucggggauagcuacaucgucaucgggguaggcgagaagaaaauaacacaucacuggcauagaagcggcagcacgauaggaaaagcauucgaagcaacaguccgcggcgcaaaacgcauggccguuuugggcgacacagcaugggacuucggcuccgugggcggcgcacucaacuccuuaggcaaaggcauccaccagaucuucggggccgccuucaaaucacuauucggcggcaugucaugguucagccagauccucauaggcacacuccuaauguggcugggacuaaauaccaaaaacggcuccaucucacucaugugccuugcccucggaggcguccuaaucuuccuuaguacagccguaagcgccgacgucggaugcuccguagacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7187 - RNA, 2503 nt, Artificial Sequence
  ZIKV prME variant mRNA Design 2 opt
ggggcgcugccuacggagguggcagccaucuccuucucggcaucaagcuuaccauggaaaagaaaagacgcggcgccgacacgagcgucgguauaguaggacuucuacucacgaccgccauggcggccgaaguaaccagacggggcagcgccuacuacauguaucucgaccgcaacgacgccggcgaagccaucucguuccccaccacacuagggaugaacaaauguuacauccaaauaauggaccucgggcacaugugcgacgcgacaaugaguuacgaaugcccaauguuagacgaaggcguagaaccggacgacgucgauugcugguguaacaccacaucaaccuggguagucuacgggaccugccaccacaaaaagggcgaagcccgaagaucacggagagccguuacccuaccgagccacuccacaagaaaauuacaaacacgaagccagaccugguuagaaucaagagaguacacaaaacaccugauaagaguagagaacuggaucuuccgaaacccgggcuucgcacuagccgccgccgcaaucgccuggcuccuaggauccucaaccagccaaaaagucauuuaccucguaaugauccuccucauagcaccagcauacuccauccgaugcaucgguguuuccaacagagacuucguagaaggcaugucgggcggcaccugggucgacaucguccuagagcacggaggcugcgugacugucauggcacaagacaagcccaccgucgacaucgagcuaguaaccacaacaguauccaacauggcugaaguccgaagcuacugcuacgaagcaucaaucucugacauggccagcgacagccgaugccccacacaaggagaagccuaccuagacaaacaaagcgacacccaauacgucugcaagcgcacccuagucgaccgcggauggggaaacgggugcggacucuucgggaagggaagccuaguaacaugcgccaaauucgcgugcucaaagaaaaugacgggcaagaguauccagcccgaaaacuuagaauacagaaucaugcucucgguucacggaucccaacacagcggcaugauaguaaacgacaccggccacgaaacagacgaaaacagggcaaaaguagaaaucacccccaacucacccagagccgaagccacgcucggcggcuucgggucacucgggcucgacugcgagccccgaaccggacuugacuucagcgaccuuuacuaccuaacaaugaacaacaagcacugguuagugcacaaagagugguuccacgauaucccacuccccuggcacgcaggcgcagacaccgguacaccccacuggaacaacaaagaagcacucguagaguucaaagaugcccacgcaaaaaggcaaaccgucguaguauuaggcagccaagaaggcgcaguacacaccgcccucgccggagcccuagaagcagaaauggacggcgcaaaaggaagacucuccucaggccaccucaaaugccgauugaagauggacaaacuucgacucaagggagucaguuacucauuaugcacugcagccuucaccuucaccaaaaucccggcagaaacgcuacacggaaccguaaccgucgaaguccaauaugcaggcaccgacggcccgugcaaaguacccgcccagauggcggucgacaugcaaacgcugacaccgguaggucgccucauaaccgccaaccccguuauaacggaauccaccgaaaacuccaaaaugaugcucgaacuagacccgcccuucggagacagcuacaucgugaucggugucggagaaaagaaaauaacccaccacuggcacagaagugggagcacaaucggaaaagccuucgaagccaccgucagaggcgccaaacgcauggccguccucggcgacacagcaugggacuucgggagcgucggcggugcccuaaacagccucggcaaaggcauacaccaaauauucggagcagcuuucaagagcuuauucgggggcaugagcugguucucccaaauccuaaucgggacccuacucauguggcucggacuaaacaccaaaaacggaagcauuagccucaugugccuggcccucgggggcguacucaucuuccugucgaccgccguaagcgcugaugucggaugcuccguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7188 - RNA, 2500 nt, Artificial Sequence
  ZIKV prME variant mRNA Design 2 opt
ggggcgcugccuacggagguggcagccaucuccuucucggcaucaagcuuaccaugaagaaacgacggggcgcagacacauccgucggcaucguaggacuccugcuaaccacagcaauggcagccgaagucacacgcaggggcucugcauacuauauguaccuagaccggaacgacgcaggagaagccauaucguucccaaccacacugggaaugaacaaaugcuauauacagauuauggaccucggccacaugugcgacgccaccaugagcuacgaaugcccuaugcucgacgagggcguggaaccagacgacgucgacugcuggugcaacacgacaagcaccuggguggucuacggaaccugccaccacaagaaaggcgaggcgagacgcucccgacgcgcggucacccucccaagccacucaacgcgcaaacuacagacaagaucccaaacauggcucgaaagccgcgaauacaccaaacaccuaauccgagucgaaaacuggaucuuccgcaaccccggauucgcacuagccgccgccgcaauagcauggcucuuaggcucaagcaccagccaaaaaguaaucuaccucguaaugauccuucucaucgcaccagccuauucaauaagaugcauaggaguuagcaacagagacuucguagaaggaaugucgggaggaaccugggucgacaucguccucgagcacgggggcugcgucaccgucauggcucaggacaaaccaacagucgauaucgagcuagucaccacgacaguaagcaacauggcagaaguacgguccuacugcuacgaagcaucgaucuccgacauggcaucagacucacgaugcccaacccaaggcgaagcauaccuagacaagcaaucagacacgcaguacguaugcaagcgaacacugguagacagaggcuggggcaacggaugcggccuauucggaaagggcucacugguaaccugugcaaaauucgcaugcucaaagaaaaugacaggaaaaagcauacaacccgaaaaccucgaguaccguauaaugcucucaguccacggaagccaacauuccggcaugaucguaaacgacacaggacacgagaccgacgaaaacagagccaaagucgaaaucacgcccaauagcccacgcgccgaagccacccuaggaggcuucggaucacuaggauuggacugcgaaccacguaccggccuagacuucucagaccuauacuaccuaaccaugaauaacaaacacugguuagugcacaaagagugguuccacgacauaccacucccauggcacgcgggcgcggacacaggcacaccccacuggaacaacaaagaagcccuaguagaguucaaagacgcacacgcaaaacggcaaaccguaguaguccugggcagccaagaaggcgccguacacaccgcgcuggccggagcccucgaagcagaaauggacggcgcgaaaggaagacuauccuccggccaccuaaaaugccgacucaaaauggacaagcuaaggcugaaaggcgucagcuacucccucuguaccgcagcguuuaccuucaccaaaaucccagcagaaacccuccacggaacagugacaguagaaguccaauacgccggcacagauggcccuugcaagguaccagcgcaaauggcggucgacaugcaaacacuaacaccggucggccgccucauaacagccaaucccguaaucacagaaagcaccgaaaacagcaaaaugaugcucgaacuagacccgccauucggcgacagcuacaucgugauaggagucggcgaaaagaaaauaacacaucauuggcacagaagcggcuccacaaucggcaaagcauucgaagcaacaguaagaggcgccaaacgaauggcaguccugggugacacagcgugggauuucgggucagucggaggugcccuuaacagccuaggaaaagggauccaccaaauauucggggccgcauucaaaucacuuuucgggggaauguccugguucucccaaauccucaucggaacacuccuaauguggcucggacucaacaccaaaaacggcagcaucagccucaugugccucgcacucggaggcguacuaauauuccugucaacggcaguuagcgcagacguagggugcucagucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7189 - RNA, 2497 nt, Artificial Sequence
  ZIKV prME variant mRNA Design 2 opt
ggggcgcugccuacggagguggcagccaucuccuucucggcaucaagcuuaccaugaagaggagaggggcggacaccagcgucggcauagucggccuacuacucacgaccgcaauggccgccgaaguaacacguagaggaucggccuacuacauguaccucgacaggaacgacgccggagaagccaucucauuccccacaacacugggaaugaacaaauguuacauccaaaucauggacuuaggacacaugugcgacgccaccaugucauacgaaugccccaugcucgacgaaggcguggaacccgacgacgucgacugcugguguaacacaacaucaaccuggguagucuacggcacaugccaccacaagaaaggcgaagcccgucgcagcagaagggcaguaacccucccaagccacucaacgcggaaacugcaaacccgaagucaaaccuggcuggaaucgagggaauacacaaaacaccuaauccgaguagaaaacuggaucuuccgcaauccaggcuucgcacucgccgcagcagccauagccuggcuacucggcagcuccacaagccaaaaaguaauuuaccucgucaugauacuacugaucgcccccgccuacuccaucagaugcaucggcgucucaaaccgcgauuucgucgaaggcaugucagguggcaccuggguagacaucguccucgaacacggaggcugcgucaccgucauggcacaagacaaacccacagucgacaucgaauuggucacaaccaccgucagcaacauggccgaaguacgaagcuacugcuacgaagcgucaauauccgacauggcgagcgacucccgauguccaacucaaggagaagcguaucucgacaagcaaucggacacccaauacguauguaaacgaacccuaguagaccgcggauggggcaacggaugcggccuauucggaaaaggcucccucgugacaugugcaaaguuugccugcagcaagaaaaugacaggcaaaagcauccaaccagaaaaccuagaauaccgaaucauguugucaguacacggcucccaacacaguggaaugauagugaacgacacaggccacgaaacagacgagaaucgcgccaaagucgagauaaccccuaacucaccacgcgcagaagcgacacugggaggauucgggucccuaggccucgacugcgaaccacgcaccggcuuagacuucagcgaucucuacuaccuaaccaugaacaacaaacacuggcucguacacaaagaaugguuccacgauaucccacuccccuggcacgccggcgcugacacaggcacgccccacuggaacaacaaagaagcgcuuguggaguucaaggacgcccacgcaaaaaggcaaaccgucguaguacuaggcucacaagagggcgccguacacaccgcccuggcaggcgcacucgaagccgaaauggacggcgccaaaggacggcucuccagcggacaccucaagugccgccuaaaaauggacaaacugagacuaaaaggcguaucauacagccugugcaccgccgcauucaccuucaccaaaauacccgcggaaacccuacacggcacaguaaccguagaaguacaauacgcaggcaccgacggccccugcaaaguaccggcccagauggccguagacaugcaaacccucacucccgucggacgccucaucacagcaaaccccgucauaacagaauccaccgaaaacagcaaaaugaugcucgaacucgacccacccuucggagacuccuacauaguaaucggagucggcgagaagaaaaucacccaccacuggcaucgaucaggaucaacgaucggcaaagcauucgaagcaaccgugcggggagcaaaaaggauggccguacucggcgacaccgccugggacuucgggucagucgggggcgcccuaaacucccugggaaaaggcauucaccaaaucuucggugccgccuucaaaagccuguucgggggcaugagcugguucagccaaauacucauaggcacacuccugauguggcuaggccucaacaccaagaacggcagcaucaguuuaaugugccuagcccugggaggaguccucaucuuccucagcacagccguaucagcagacguaggcuguagcgucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7190 - RNA, 2494 nt, Artificial Sequence
  ZIKV prME variant mRNA Design 2 opt
ggggcgcugccuacggagguggcagccaucuccuucucggcaucaagcuuaccaugcgccggggcgcagacacaucagugggcaucguaggccuccugcucaccaccgcgauggccgcagaggucacccgacgcgggagcgccuacuacauguaccuagaccgaaacgaugccggcgaagccaucucguucccgacaacccugggcaugaauaaaugcuacauccaaauaauggaccuaggucacaugugcgacgcaacuaugucuuacgaaugcccgaugcucgacgaggguguggaaccugaugacguagacugcuggugcaacaccacaagcacaugggugguauacggaacaugccaccacaagaaaggcgaagcacgacggagccggcgcgcagucacccuaccgagccacucaacccgaaaacuccaaacccgcagccaaacaugguuggaaagccgcgaauacacaaaacaccuaauccgcgucgaaaacuggaucuuccgcaacccgggcuucgcccucgcagccgcagccaucgccuggcuuuuaggcucauccaccucacaaaaaguaaucuaccuagucaugauccuacucauagccccugcauacuccaucaggugcauaggcguauccaacagggacuucgucgaaggcaugagcggcggcaccugggucgacaucguacucgaacacgggggcugcguaacagucauggcacaagacaaacccacagucgacaucgaacucgugacaaccacagucagcaacauggcagaaguaagaucauacugcuacgaagcauccauaagcgacauggcaucugacagcagaugcccaacacagggagaagcauaccucgacaaacaaagcgacacacaauacgucuguaaacgaacccuaguagaccgcggauggggaaacggcugcggacucuucggaaaaggcagccucguaacaugcgccaaauucgccugcagcaagaaaaugaccggcaaauccauacaacccgaaaaccucgaguacagaaucaugcuuucaguccacggaagccaacauuccggcaugauagucaacgacaccggacacgaaaccgacgaaaacagagcgaaagucgaaaucacacccaacucacccagggcggaagcaacacugggaggauucgggucacucggucuugauugugaaccccgaacuggacucgacuucuccgaccucuacuaccucaccaugaacaacaaacacuggcuaguccacaaagagugguuccacgacaucccacuacccuggcacgcaggagccgacacaggcaccccacacuggaacaacaaagaagcacuggucgaguucaaagacgcacacgccaaacgccaaacugucgucguacuaggcagccaggaaggagcaguccacacagcacuggccggagcucuagaagcagagauggacggcgcgaaaggacgccuaagcucaggccacuuaaaaugccgacucaaaauggacaaacuccgucuuaaaggagucucguacucacugugcaccgcugcauucaccuuuaccaagauccccgcggaaacccuacacggaaccgucacaguagaaguccaauacgccggaacugacggcccaugcaaaguccccgcccaaauggcaguggauaugcaaacccuaacccccguaggacgccuaauaacagccaaccccguuaucaccgaauccaccgaaaacucuaaaaugaugcuggaacuagauccacccuucggagacuccuauauaguaaucggcgucggagaaaagaaaaucacgcaccacuggcaccggagcggcucaaccaucggaaaagccuuugaggcgaccguccgcggagccaaacgcauggcaguacucggagacacagccugggacuucgggagcgucggaggcgcccuaaacucacucggcaaaggcauccaccaaaucuucggagccgcauucaaaucccucuucggcggcaugagcugguucucacagauacuaauaggaacccuccuaauguggcucggccucaacaccaaaaacgguagcaucagccuaaugugccuagcacuaggcggcguacuaauauuccucuccaccgccgucagcgccgacgugggcuguuccgucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7191 - RNA, 2491 nt, Artificial Sequence
  ZIKV prME variant mRNA Design 2 opt
ggggcgcugccuacggagguggcagccaucuccuucucggcaucaagcuuaccaugagaggcgccgauacuagcguaggaaucgugggacuccuacucacaacugcaauggccgcagaagucacaagacgaggaagcgcauacuacauguaucuagaccggaacgacgccggagaagcaaucagcuucccgacaacacuaggaaugaauaaaugcuauauccaaauaauggaccuaggccacaugugcgacgcgaccaugagcuacgagugccccaugcucgaugaaggcgucgaaccagacgacgucgacugcuggugcaacacuacaagcacauggguaguauacgggacaugucaccacaagaaaggagaagccagacgcucgcgccgcgcagucacacuccccucacacucaacacggaaacuacaaacgcgcucgcaaaccugguuggaaucccgagaauacaccaaacaccuaauccgcgucgaaaacuggaucuuccgcaacccggguuucgcacucgcagccgcagccaucgccuggcuacucggcagcucaacaagccaaaaagucauauaccuaguaaugauacuacugaucgcaccagccuacagcaucagaugcaucggcgucucaaaccgcgacuucgucgaaggaauguccggcggaaccuggguagacaucguacuagaacacggcggaugcgucaccgucauggcacaagacaaacccacaguagacauugagcucguaacaacaacagucuccaacauggccgagguccgaucauacugcuacgaagcauccaucagcgacauggccagcgacuccaggugcccgacccaaggcgaagccuaucucgacaaacagagcgacacgcaguacgucugcaaacgaacauuagucgaccgaggcuggggaaacggaugcggccuauucggaaaaggaagccuagucacgugcgcaaaauucgcaugcucaaagaaaaugaccggaaaaucgauccaacccgaaaaccuggaauaccgaauaaugcucuccguacacgggagccagcacucaggaaugauagucaaugacaccggccacgaaacagacgagaaucgagcuaaaguagagauaacacccaacagccccagagcagaagcgacccucggcggcuucggcucccucggcuuagacugcgaaccacgcaccggccucgacuucagcgaccuauacuauuuaacaaugaacaacaaacacuggcuagugcacaaagaaugguuccacgacauaccacuaccauggcacgcaggggcagacacggggaccccacacuggaacaacaaagaagcccuaguagaguucaaagacgcacacgcaaaacgacaaacaguagucguacuugggagccaggaaggcgcaguccacaccgcacuagccggggcccucgaagcagaaauggacggggcaaaaggcagacuaagcagcggacaucugaaaugcagacucaaaauggacaaacuccgccuaaaaggcguguccuacucacuaugcaccgcagccuucaccuucacgaaaaucccagcggaaaccuuacacggcaccgucacaguggaaguacaauacgccggcaccgacggaccaugcaaaguaccagcacagauggccgucgauaugcaaacacugacgcccgucggacgacugaucacugcaaacccgguaaucaccgaaagcacagaaaacucaaaaaugaugcucgagcucgacccucccuucggagacagcuacaucgucaucggagucggagaaaagaaaauaacucaucacuggcaccgcagcggaucaaccaucggcaaagccuucgaagcuacagucagaggcgcaaagagaauggcgguacuaggcgacacagcaugggacuucggaucagugggaggcgcacugaacagccucggaaaggggauacaccaaaucuucggcgccgcauucaaaagccucuucggcggcaugagcugguuuucccagauacuaaucggaacgcuccuaauguggcuagggcuaaacaccaaaaacggcagcauaagccugaugugccucgcgcucggaggcguccucaucuuccuaucaaccgcagucucggcagauguaggcugcucagucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7192 - RNA, 2488 nt, Artificial Sequence
  ZIKV prME variant mRNA Design 2 opt
ggggcgcugccuacggagguggcagccaucuccuucucggcaucaagcuuaccaugggggccgacacuuccguaggcaucgucggacuacuccugaccacggccauggccgccgaaguaacccgccgcggcagcgcauacuacauguaccucgaccgcaacgacgccggggaagcuauaucguucccaacaacccucggaaugaacaaaugcuacauacaaaucauggaccucggccacaugugcgacgcaaccaugagcuacgaauguccaaugcuggacgaagggguagaaccagacgacguggacugcuggugcaacaccacaagcaccugggucgucuacggaaccugccaccacaagaaaggagaggcccgacgaagucgccgcgcagucacccucccaagccacucuacacgaaaacuucaaacccggucacaaacauggcucgaaucaagagaauacaccaaacaccucauccgagucgaaaacuggaucuucagaaaccccggauucgcccucgcagcggccgccauagcguggcuacuaggcucaagcaccucacaaaaagucaucuaccuggucaugauccuccuaauagcacccgccuacagcauccgcugcaucggcgucucaaacagagacuucguagaaggaaugagcggaggaacauggguagacauagugcucgaacauggaggcugcguaaccgucauggcccaagacaaaccaaccgucgacauagaacuggucacuacaaccguaucuaacauggccgagguaagaucauacugcuacgaagccuccaucuccgacauggccagugacagccgaugcccaacgcaaggcgaagccuaucucgacaaacaauccgacacccaauaugucugcaagcgcacacucguagaccgcggcuggggaaacggcugcggccucuucggcaaaggcagccuaguaaccugcgcaaaauucgcaugcuccaagaaaaugacaggaaaauccauccaacccgaaaaccucgaauaccgcaucaugcucuccgugcacggcagccaacacuccggaaugaucguaaacgacaccggacacgaaacagacgaaaaccgcgccaaagucgaaauaacaccaaacuccccacgcgcggaagccacacuaggcggcuucggcucccuaggccucgacugcgaacccagaacaggacucgacuucagcgaccucuauuaccuaaccaugaacaacaaacauugguuaguacacaaggaaugguuucacgacaucccccuccccuggcacgcaggcgcagauacaggaacaccacacuggaacaacaaagaagcccucguagaauuuaaagacgcccacgcuaaacggcaaacaguaguaguccuaggcagccaagagggggccguacacaccgcacucgcaggcgcccucgaagcugaaauggauggcgccaaaggcaggcucucaucgggucaccucaaaugccgacuaaaaauggacaaacuacgucuaaaaggggucucuuacucacucuguacggcggccuucaccuucaccaaaauaccagcagagacacuacacggaaccgucacagucgagguccaauacgccggcacagacggaccaugcaaagucccugcacaaauggccgucgacaugcaaacccucacaccaguaggacgccucaucacggccaaccccgucaucacagaaagcaccgaaaacuccaaaaugaugcucgaacuagaucccccguucggagacagcuacaucguaauaggcgucggagagaagaaaauaacacaccacuggcaccgauccggauccacaauaggcaaagccuucgaagcaaccgucagaggcgcaaaacgaauggccguacugggagacacagccugggacuucggaagcgugggcggagcacucaacagccuuggcaaaggaauccaccaaaucuucggcgcagcauucaaaucacucuucggaggcauguccugguucucacaaauacugauagggacacuccugaugugguuaggucucaacaccaaaaacggcagcauuucucucaugugccucgcccucggaggaguacucaucuuccucuccacagcggucagcgcagacgucggaugcuccgucgacuuuucgaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7193 - RNA, 2485 nt, Artificial Sequence
  ZIKV prME variant mRNA Design 2 opt
ggggcgcugccuacggagguggcagccaucuccuucucggcaucaagcuuaccauggccgacaccagcgucggaaucgucgggcuccuauugaccaccgccauggccgccgaagucacccgccgcggaagcgccuacuacauguaccuagaccgaaacgacgcaggcgaagccaucagcuuccccacaacacuaggcaugaacaaaugcuacauucaaaucauggaccuaggccacaugugcgacgcaaccaugucauacgagugucccaugcuagacgaaggaguagaaccagacgauguagacugcuggugcaacaccaccuccacaugggucgucuacggaaccugccaccacaaaaagggcgaggcacgacgaucacgccgcgccgucacucuaccaucacacucaacucgaaaacuacaaacccgcucccaaacaugguuagaaagccgcgaguauacgaaacaccuaauccgaguagaaaauuggauauuccggaacccaggcuucgcacuggcagccgccgcaaucgcauggcuucugggauccucaacgucacaaaaagucaucuaccucgucaugauacugcucauagcaccagcauauuccauccgcuguaucgggguauccaacagggacuucguugaaggcaugucaggagggacaugggucgacaucguccucgaacacggaggcugcgucacagucauggcacaagacaaacccaccguagacaucgagcucgucaccacaacagucagcaacauggccgaaguccgcagcuacugcuacgaagcaucaaucagcgauauggccagcgacucaaggugcccuacucaaggcgaggcuuaccuagauaaacaaagcgacacccaauacgucugcaaacgcacccuaguagaccgaggauggggaaacggaugcggccucuucggcaaaggcucccucgugacaugcgcaaaauucgcaugcagcaagaaaaugacaggcaaaagcauacaaccagaaaaccucgaauacagaaucaugcugagcguccacgggucacaacacucaggcaugauagugaacgacaccggccacgaaaccgacgaaaaccgcgcaaaaguagaaauaaccccaaacagcccacgagccgaagccacccuaggcggcuuuggaagccucggccuagacugcgagccccgcaccggucuagacuucagcgaccucuacuaccugaccaugaacaacaaacauuggcucgugcacaaagagugguuccacgacauaccccuaccuuggcacgcaggagcagacaccggcacaccccacuggaacaacaaggaggcacugguagaguucaaggacgcccacgcaaaacgacaaacaguagucgugcuaggaucucaagaaggcgccguccacacagccuuagccggggcacucgaagcagagauggacggagccaaaggacgacuauccuccggccaucucaaaugccgccucaaaauggacaagcuccgacuaaaaggcguaagcuacagccuuugcacggcagcauucacguucacgaaaauucccgccgaaacacuccacggcacaguaaccgucgaaguacaauacgccggcacagaugggcccugcaagguccccgcccaaauggcaguugacaugcaaacccucacccccguaggccggcugaucaccgccaacccagucaucaccgaauccaccgagaacagcaaaaugaugcucgaacucgaucccccuuucggagacuccuacauagucaucggaguaggagaaaagaaaaucacccaccacuggcaccgcagcggcuccaccauaggaaaagcauucgaagcuaccguccgcggggccaaacgcauggccguacucggcgacacggcgugggacuucggcucgguuggaggagcccuaaauagccucggcaaaggaauccaccaaauauucggagcggcuuucaaaucccuuuucgguggcaugucaugguuuagccaaauucucaucggaacacugcucauguggcugggcuuaaacaccaaaaauggaucaaucucgcucaugugccuagcacuaggagggguccuaauauuccugucaaccgcagugagcgccgacguaggcugcagcgucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7194 - RNA, 2482 nt, Artificial Sequence
  ZIKV prME variant mRNA Design 2 opt
ggggcgcugccuacggagguggcagccaucuccuucucggcaucaagcuuaccauggacacaucaguuggcaucgucgggcugcuacucaccacggccauggccgcagaagugacaagaagaggaagcgcauacuacauguaucuggaucgcaacgacgccggcgaagcgaucagcuucccaacgacccucggaaugaacaaaugcuacauacagaucauggaccuaggacacaugugcgacgcgaccauguccuacgagugcccaaugcuagacgaaggcgucgagccagacgacgucgacugcugguguaauacgaccucaaccuggguagucuacgguacaugccaccacaagaaaggcgaagcacgaagaucaagacgagccgucacccuacccucacacagcacuagaaaacuccaaacccgaagucaaacauggcuagaaagucgagaauacacgaaacaccugauccgcguagaaaacuggauauuccgaaacccaggcuucgcgcucgccgcagccgccauagccuggcuccucggcagcagcaccagucagaaggucauauaucucgugaugauccuccucaucgccccugccuacucaauaagaugcaucggcguaagcaaccgggacuucguggaaggaaugucuggaggcaccuggguagacauaguccucgaacacggaggcugcguaacuguaauggcccaagacaaaccuacagucgacauugaacuggucaccaccaccguauccaacauggccgaagugcgcagcuacugcuacgaagccagcaucucagacauggcgagugacagccgaugccccacucaaggcgaagccuaccuagacaaacaaagcgacacacaauacgucugcaaacgaacacucgucgaucguggaugggguaacggaugcggccucuucggcaaagguucccuagucacuugcgcaaaauucgccugcagcaaaaagaugacaggaaagagcauacaacccgaaaaccuagaauaccgcaucaugcugagcguccacggcagccagcacagcggaaugauaguaaacgacacaggacacgaaaccgacgaaaauagggcgaaagucgaaaucacccccaacagccccagagcggaagcaacacuagguggcuucgggagccucggauuagacugcgagccccgaacaggccucgacuucagcgaccuauacuaccuaacaaugaacaacaaacacugguuaguccacaaagagugguuccaugacaucccccucccauggcacgccggcgccgacaccggcacaccccacuggaacaacaaggaggccuuagucgaguucaaagacgcccacgcaaaacgacaaacagugguaguccuaggaagccaggaaggagccguccacacggcccucgcaggagcacucgaggccgaaauggacggcgcaaaaggccgccugagcucaggacaccucaaaugccgccuaaaaauggacaaacuaagacucaaaggaguaagcuacucccuuugcacagcagccuucacauucacgaagaucccagcagaaacacugcauggcacagugacaguagaaguacaauacgccggcaccgacggaccaugcaaagugcccgcccagauggccguagauaugcagacucuaacucccguaggcagacuaaucaccgcaaaccccgucaucaccgagagcacagaaaacagcaaaaugaugcuagagcucgaucccccauucggagacaguuacauaguaaucggaguaggcgagaagaaaaucacccaccacuggcaccgcaguggauccacuauaggcaaagccuuugaagcaacaguccgcggcgcaaaaaggauggcaguccuaggagacaccgcaugggauuucggcagcguaggcggagcacuaaacagccucggcaaaggcauacaccaaauauucggagccgccuucaagagccuauucggcggcauguccugguucagccaaauacuaaucggcacccuccucauguggcucggacugaacaccaaaaacgggucaaucagccucaugugccuggcacugggagggguacucauauuccuaagcaccgcaguaucagccgacguagguugcagcguagacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7195 - RNA, 2479 nt, Artificial Sequence
  ZIKV prME variant mRNA Design 2 opt
ggggcgcugccuacggagguggcagccaucuccuucucggcaucaagcuuaccaugaccucagucggcauaguaggacugcuccugacaacagcgauggccgccgagguaacucgaagaggaagcgcguacuacauguaccucgaccgaaacgacgcgggcgaagcaaucagcuucccgaccacccuaggcaugaacaaaugcuacauccaaauaauggaucugggacacaugugcgacgcaaccaugucauacgaaugucccaugcucgacgaaggaguagaacccgacgacguggauugcuggugcaacacaaccagcaccuggguagucuauggaacaugccaccacaagaaaggcgaagcccgacgauccagacgugccgucacgcuacccagccacagcacacgcaaacuccaaaccagaagccaaacauggcucgaaagccgagaauacaccaaacaccucauaagagucgaaaacuggauauuccgcaaccccggguucgcacuagcugcagcagccaucgcauggcuccuaggcuccagcacaagccaaaaagucauauaccuugucaugauccuacucauagcaccggccuacuccauacgcugcauaggcgucuccaaccgagacuucgucgaaggaaugagcggaggcaccuggguagauaucguccuggagcacggcggaugcguaaccgucauggcgcaagacaagccaaccguagacaucgagcucguaaccaccacgguuagcaacauggccgaaguccgcuccuacugcuacgaagcaagcauaagcgacauggcaagugacagcagaugccccacucaaggcgaagcguaccucgacaaacaaagcgacacacaauacguaugcaaacgaacccucguagacagaggcuggggcaacggcugcggccuauucggaaagggcucccucguaaccugcgcgaaguucgccugcucaaagaaaaugacaggcaaaucgauacaaccggaaaaccucgaauacagaauaaugcuguccguccacggaucacaacacagcggaaugauagugaaugacacaggacaugaaaccgacgagaaccgagcaaaagucgaaauaacaccaaacuccccacgggccgaagccacccucggagguuuuggcagcuuaggccucgacugcgagccacgaacgggccucgacuucucagaccucuacuaccuaacgaugaacaacaaacacuggcuuguccauaaagaaugguuccacgacauaccccuccccuggcacgccggagccgacaccggcacaccccacuggaacaacaaagaggcgcuaguagaguucaaagacgcccacgccaagagacaaaccgugguaguacuagggagccaagaaggcgcgguacacacagcacuagccggagcccucgaagccgaaauggauggagcaaaagggcgacucagcuccggccaccucaaaugccgccuaaaaauggacaaacuaagacugaagggcguaagcuacagccuaugcacagccgcauucaccuucaccaaaauacccgccgaaacccuacacggaacagucaccgucgaaguccaauacgccgguaccgacggaccgugcaagguaccggcacaaauggcaguagacaugcaaacucuaacccccguaggcagacucaucacggccaaccccguaauaaccgaaucuacagaaaacaguaagaugaugcucgaacucgacccacccuuuggcgacuccuacaucgucauaggagucggagaaaagaaaaucacccaccacuggcacaggaguggcagcacaaucgguaaagccuucgaagccacaguacgcggggcaaaacgcauggcgguccucggcgacacagcaugggacuucgggagcguaggcggcgcgcuaaacagccucggcaaaggcauccaccagaucuucggcgcggcauucaaaucacuauuuggagggaugagcugguucucucaaauccucauaggaaccuugcugauguggcugggccuaaacacgaaaaacgggagcaucagccucaugugccuugcccuagguggcguccuaaucuuccuuagcacagccgucucagccgacgucggaugcagcguggacuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7196 - RNA, 2479 nt, Artificial Sequence
  ZIKV prME variant mRNA Design 2 opt
ggggcgcugccuacggagguggcagccaucuccuucucggcaucaagcuuaccaugaccagcgucgguauaguaggccuacuacuaacaacggccauggcagccgccgugacacgcagaggaucugccuacuacauguaccuagaccgcaacgacgccggcgaagcgaucuccuucccuacuacccugggcaugaacaaaugcuacauccaaaucauggaccuaggacacaugugcgaugccacaaugucauacgaaugcccuaugcuggacgagggagucgaacccgacgacguagauuguuggugcaacaccacaagcacauggguaguauauggaacaugccaccacaaaaagggcgaagcgcgcagaagccgccgcgccgucacccuacccagccacuccacaagaaaacugcaaacgagaagccaaaccuggcucgaaucccgcgaauacaccaaacaccucauccgcgucgaaaacuggaucuuccgaaaccccggcuucgcgcuagccgcggccgcuaucgcguggcuccugggaucaaguaccagccaaaaaguaaucuaccuaguaaugauccuccucaucgcaccagccuacuccauccgaugcauuggcguaagcaacagagacuucgucgagggcaugaguggcggcaccuggguagacaucgugcuagaacacggaggcugcgucaccguaauggcccaagacaaacccacagucgacauagaacucguaacaacaacgguuucaaacauggcagaggugagaucguauugcuacgaagccagcaucagcgauauggccagcgacagccgcugcccgacacaaggagaagcguaccuggacaaacaaagcgacacccaauacgucugcaagcgaacacucguagaccgcggguggggcaacggcugcggacuauucggaaaaggaagccuuguaaccugcgcaaaguucgccugcagcaagaaaaugacaggcaaaagcauccaaccagaaaaccucgaauaccggaucaugcucagcguccauggcucacaacacagcggcaugauagucaacgacacgggccacgaaacagacgaaaaccgagcaaaaguagaaauaacccccaacuccccaagagcggaagccacccuaggcggauucggaucccucggacucgacugcgaaccacgaaccggacucgacuucucagaccucuacuaccucaccaugaacaacaaacacuggcucguccacaaagaaugguuccacgacauaccacucccauggcacgccggcgccgacacaggcacaccacacuggaacaacaaagaggcccuugucgaguucaaagacgcacacgcaaaacgccaaaccgucguaguccucggaucccaagaaggagcgguccacaccgcccucgcaggcgcccuagaagccgaaauggacggagcgaaaggacgccuaucaucggggcaccucaagugcagacucaaaauggacaaacuccgacuaaaaggcgucagcuacucacucugcaccgccgcauucacguucaccaaaauccccgccgaaacccuacacggaacagugacaguagaagugcaguacgcaggaacagacggaccaugcaaaguccccgcccagauggcaguagacaugcaaacacucacaccagugggacgccuaaucaccgccaaccccguaaucacagaaagcaccgaaaacagcaaaaugaugcuagaacucgacccacccuucggggacuccuacaucguaauaggagucggggaaaagaaaaucacgcaccacuggcaccgaagcgguuccacaaucggcaaagccuucgaagcaacaguacgcggcgcaaaacggauggcgguccucggagacaccgcaugggacuucggaagcgucggaggcgcccuaaacagucuaggcaaaggaauacaccaaauauucggugcggccuucaaaagucuauucggcggcaugagcugguucagccaaauccucauaggaacacucuuaauguggcucggccuaaauacuaaaaacggcucaauuagccuaaugugcuuagcacuaggaggcgugcucaucuuccugucaaccgccgucuccgccgacguaggcugcagcguagacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7197 - RNA, 2491 nt, Artificial Sequence
  ZIKV prME variant mRNA Design 2 opt
ggggcgcugccuacggagguggcagccaucuccuucucggcaucaagcuuaccaugcgaggcgcagacacgagcguaggcaucgucggccugcuuuuaaccacagcaauggcugcagccguaacccgacgaggaagcgcauauuacauguaccuagacagaaaugacgcaggagaagcaauaucguuccccacaacacuaggaaugaauaagugcuacauccaaaucauggaccucggacacaugugcgacgccacgaugucguacgaaugccccaugcuagacgaaggagucgaaccagacgacguggauugcugguguaacacaaccucaaccugggugguauacggcacgugccaccacaagaaaggcgaagcaagacgaucaagacgagcaguaacucuccccucccacagcaccagaaaacuccagacaagaucccaaacauggcuagaaucacgagaauacacaaaacaccugauaagagucgaaaacuggauauucagaaaccccggauucgcacucgccgcagcagccauagcauggcucuuaggcagcucaacaagccaaaaaguaaucuaccuagucaugauccuacuaaucgcgcccgcguacucgauccgcugcaucggcguaucgaacagagacuucgucgaaggcauguccggagggacgugggucgacauagugcuagaacacggcggaugcgucacagucauggcacaagacaaaccgacggucgacauagagcuaguaaccaccacaguaagcaacauggcagaagucagaaguuacugcuacgaagcauccauaucagauauggcaucagacuccagaugcccgacccagggagaggccuaccuagacaaacaaucagauacccaauacgucugcaaacgaacccugguagaccgcggcuggggaaacggcugcggccuguucggcaaggggagcuuaguaaccugcgcaaaauucgcaugcagcaagaaaaugaccggaaaaagcauccaacccgaaaaccucgaauaucgcauaaugcucagcguccacggcagccaacacagcggaaugauagucaacgacacaggccacgaaacagacgaaaacagggcaaaagucgaaaucacaccaaauagcccaagggccgaagcaacacucgggggcuucgggucacuuggccuagacugcgaacccagaacgggacuagacuucagcgaccuguacuaccucaccaugaacaacaaacacuggcuaguacacaaagaaugguuccacgacauaccccucccauggcacgcaggagccgacaccgggacgccacacuggaacaacaaggaagcacucgucgaguucaaagacgcccacgcaaagcgccaaacaguagucguacugggcucccaagaaggggcaguacacacggcacucgcaggcgcacucgaagcagaaauggacggcgccaaaggccgccucucaagcggacaccucaaaugccgccucaagauggacaagcuccgacucaaaggcguaagcuacagccuuugcacagcagcauucacauucacaaaaauacccgcagaaacacuccacggcacagucacagucgaagugcaauacgcaggaaccgacggcccaugcaagguaccagcacaaauggcagucgacaugcaaacgcuaaccccagucggccgccucauaaccgcaaacccaguaauaacugagagcacagaaaacagcaagaugaugcucgagcucgacccacccuucggcgauagcuacauagugauaggagucggcgagaaaaagaucacgcaccauuggcacagaagcggaagcacaauaggaaaagcguucgaagcaacagucagaggcgcaaaacgcauggccguccucggcgacacagcaugggacuucggcucaguaggaggggcacucaauagccuaggcaaaggaauacaccagauauucggagcggcauucaaaagccuguucggcgguaugagcugguucagccagauacuaauuggaacccuacuaauguggcuaggccuaaacaccaaaaacggaagcaucagccuaaugugccuagcacuuggcggaguacucauauuccucagcacagcagucuccgccgacguaggaugcagcgucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7198 - RNA, 2515 nt, Artificial Sequence
  ZIKV prME variant mRNA Design 2 opt
ggggcgcugccuacggagguggcagccaucuccuucucggcaucaagcuuaccaugcgagggcucucaucacgcaaacgccgcagucacgacguccuaaccguccaauuucuaauccuaggaaugcuccuaaugaccggaggggucacccgcagaggcucggccuacuacauguaccucgacaggaacgacgccggcgaagcaauuagcuuccccacaacccuugguaugaacaaaugcuacauacaaauaauggaccuaggacauaugugcgacgcaacgauguccuacgagugucccauguuggacgaaggcguagaaccagacgacguggacugcuggugcaacaccacaagcacauggguuguauacggcacaugccaccacaagaaaggagaagcccgccgaucacgacgugccgucacccugcccagccacagcacgcgcaaacuacaaacucgcucgcaaaccuggcuggaaagccgcgaauacacaaaacaccucauccgagucgagaacuggauauuccgcaaccccggcuucgcacucgcggcagccgcaauagcauggcuucuagggucaagcaccagccaaaaagucaucuaccucguaaugauccuccugaucgcccccgccuacuccaucagaugcaucggaguaucaaacagagauuucguagaaggcaugucagguggaaccuggguagacaucguacuagagcacggaggcugcgucaccgucauggcacaggauaaacccacagucgacaucgaacuggucacgaccacugucucaaacauggccgaagugcguagcuacuguuacgaagccagcaucagcgacauggcgagcgacagucgaugccccacccaaggggaagcauaccucgacaaacaaagcgacacacaauacguaugcaagcgaacacucguagaccgcggcugggggaacggaugcggacucuucggaaaaggcagccuagugaccugcgccaaauucgcuuguucaaagaaaaugaccggcaaaagcauacaaccggaaaaccucgaauacagaauaaugcucuccgugcacggaucucagcacagcggcaugauagucaacgacaccggccacgagaccgacgaaaacagggcgaaagucgaaauaacaccgaacagcccccgagccgaggcgacacucggcggcuucgggucccucggccuagauugcgaaccccgcacaggccucgacuucagcgaccucuauuaucuaacaaugaacaacaaacacuggcuaguccacaaagaaugguuccacgacauuccacuccccuggcacgcgggagcggacacgggaacaccacacuggaacaacaaagaagcacucguagaguucaaagacgcacacgccaaacgacaaaccguaguaguacuaggaagccaagaaggcgccgugcacacagcacuagcaggggcccuagaagccgaaauggacggcgccaaaggccgacuaagcaguggacaccuaaaaugccgccuaaaaauggacaaacuacgccuaaaaggagucagcuauagccuaugcacagccgcauucacguucacaaaaauucccgcggaaacgcuacacggaacuguaaccgucgaaguacaauacgccggcaccgacggaccgugcaaggucccugcacaaauggcuguagacaugcaaacacucacaccggucggccgucuaauaacagccaaccccguaaucaccgaauccaccgaaaacucaaaaaugaugcuggaacucgacccacccuucggagacaguuacauagucaucggagucggagagaaaaagaucacucaccacuggcacagaucaggcucaacgaucggaaaagccuucgaagcaacaguccgcggggcaaaaagaauggccguccuaggagacacagccugggauuucgguagcguaggaggagcccucaacucccuaggaaagggcauacaccaaauauucggagccgccuucaaaagccucuucggaggcaugucgugguucucgcaaauacuaaucggcacccuccugauguggcuagggcuaaacaccaaaaacggaucgaucucucucaugugccuagcccucgguggcgugcuaauauuccucuccaccgccgucagcgcggauguaggaugcagcguagacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7199 - RNA, 2515 nt, Artificial Sequence
  ZIKV prME variant mRNA Design 2 opt
ggggcgcugccuacggagguggcagccaucuccuucucggcaucaagcuuaccaugcgcggacucagcucccgcaaacgacgcucacacgacguacuaaccgugcaauuccucauccuugggaugcuacucaugacaggcgcggugacccgacgcggcagcgcauacuacauguaccucgaccgaaacgacgcgggcgaagcaaucagcuuccccacaacacucggcaugaacaaaugcuacauacaaauaauggaccucggacacaugugcgacgccaccaugucguacgagugcccaaugcuagacgaaggcguagaacccgacgacgucgacugcuggugcaauaccaccucaacauggguagucuacggcacaugccaccacaagaaaggagaagcccgccgcucuagacgcgccgucacucuccccagucacucaacccgaaaacuccaaacgcgcucccaaacauggcucgagucccgcgaauacacaaaacaccucauccgaguagaaaacuggaucuuccgaaaccccggauucgcacucgccgcagcagccauagcauggcuccugggaucaagcacaucccagaaaguaaucuaccucgucaugauccuacuaaucgcucccgcguacagcauacgaugcauaggcgucagcaacagagacuucguagaaggaaugucgggcggcacauggguagacaucgugcucgagcacggcggaugcguaaccguaauggcccaagacaaacccacaguagacaucgagcucguaacuaccacagucaguaacauggccgaaguccgcagcuacuguuacgaggccucaauuucagacauggccuccgacagucgcugcccaacacaaggcgaagcguaccuggacaaacaauccgacacccaauacguaugcaaacgcacccucguugacaggggguggggaaauggaugcggauuauucgguaaagggucccuaguaaccugcgccaaauucgcaugcucaaagaaaaugaccggcaaaucaauacaaccagagaaccuagaauaccgcauaaugcucagcguccacgggagccaacauuccggaaugaucguaaacgacaccggacacgaaaccgaugagaaucgcgcaaaaguagaaaucacaccaaacuccccacgggcugaggcgacacuaggcggcuucggcagccuaggccuagacugcgaaccccgcaccgggcucgacuucucggaccuguacuaccucacgaugaacaacaaacacuggcucguacacaaagaaugguuccacgauaucccccucccauggcacgccggcgccgacaccggaacaccccacuggaacaacaaagaagcccucguagaguucaaagacgcccacgccaaaagacaaacagugguuguacuagggucacaggaaggcgccguacacacagcacucgccggagcccucgaagccgaaauggacggggcaaaagguagacuaaguagcggccaccucaagugccgacucaaaauggacaagcugcgacugaaaggggucaguuacucccuaugcaccgcugcauucaccuucaccaagaucccggccgaaacccuacacggaacagucaccgucgaagugcaguacgccggcacagacggccccugcaaaguacccgcgcaaauggccgucgacaugcaaacacucacgcccgucggacggcucaucacagccaaccccguaaucacggaaagcacagagaacagcaaaaugaugcuagaacuagacccacccuucggagacuccuacauaguaaucggcguaggcgagaagaaaauuacacaccacuggcacagguccggcucaacgauugguaaagccuucgaagcaacaguccgcggugccaagcgcauggcaguccuaggcgacacagcaugggacuucggcucagucggcggcgcacucaacagucugggaaagggcauacaucagauauucggcgcagccuucaagucgcuauucggagggaugagcugguucagccagauccucaucggaacacugcucauguggcuaggacuaaacaccaaaaacgguagcaucagccucaugugccuagcacuaggcggaguccuaauauuccuuagcacggcagucagcgccgacgugggcugcagugucgacuucucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7200 - RNA, 2506 nt, Artificial Sequence
  ZIKV prME variant mRNA Design 2 opt
ggggcgcugccuacggagguggcagccaucuccuucucggcaucaagcuuaccaugcgcaucaucaacgcgcgcaaagaaaagaaacgacgcggagccgacaccucggucggaauagucggccuccuacugacaaccgccauggcagccgaggucacccgacgaggcuccgccuacuacauguaccucgaccgcaacgacgccggagaggccauuuccuuccccaccacccucggcaugaacaaaugcuacauccaaauuauggaccuaggacacaugugcgacgcaacaaugagcuacgaaugcccaaugcuagacgaagguguagaacccgacgacguagacugcuggugcaacacaacauccacaugggucguguacgguacaugccaucacaagaaaggcgaagcacgccgcagccgacgcgccguaacccucccaucccacagcacaaggaaacuucaaacacgcagccagacguggcucgaaagcagagaauacacaaaacaccucauacgaguagaaaacuggauauuucgcaacccgggcuuugcccucgccgccgcggccauagcauggcuauuaggcagcaguacgucccaaaaaguaauuuaccuagucaugauacuacuaauagcaccagccuacuccauaaggugcaucggagugucaaaccgcgacuucgucgaaggaaugagcggaggaacaugggucgacaucguccucgaacacggcgguugcgucacagucauggcccaagacaaacccacaguagacaucgaacucgucacgacaacaguauccaauauggccgaaguacgauccuacugcuacgaggcaagcauaucagacauggccuccgacucaagaugcccaacccaaggagaagccuaccucgacaaacaguccgacacucaauacgugugcaaacggacacuugucgaccgcggguggggcaacggauguggccuauucggcaaaggcagucugguaaccugcgcaaaauuugcaugcuccaagaaaaugacagggaaauccauacaacccgaaaaccucgaauacagaaucaugcucucaguccacgggucacagcacagcggcaugauaguaaacgacaccggccacgagacagacgaaaaccgcgccaaaguagaaauaaccccaaacagcccccgggccgaggccacccugggcggguucggcagccucggucucgacugcgaaccccgaacaggucuagauuucucagaccuauacuaccuaaccaugaacaacaaacauuggcucguacauaaagagugguuccacgacaucccacucccauggcacgcaggcgcggacaccgguaccccacacuggaacaacaaagaagcgcuagucgaguucaaagacgcacacgcaaaaagacaaacagucguaguccuaggcucccaggaaggagccguccacacggcacucgccggagcacucgaggcagagauggacggcgccaaaggccgccucagcucaggacaccuaaaaugccgccucaaaauggacaaacucagacucaaagggguaucauacagccuaugcacagccgcauuuacguucaccaaaauaccagccgagacacuccacggcaccguaacagucgagguccaauacgcaggaacagacggccccugcaaagucccagcccaaauggccgucgacaugcaaacacucacacccgugggccgucuaauaaccgcaaaccccguuauaacagaauccacagaaaacuccaaaaugaugcuggaacucgaucccccauucggggacagcuacaucguaaucggcguaggcgaaaagaaaaucacccaccacuggcaccgcuccggaagcacaauaggcaaagcauucgaagcaaccguccgcggagcgaaaagaauggcuguacucggagacaccgcgugggacuucggcagcgugggcggcgcacucaacucccuaggaaaaggcauccaccagauauucggcgcagccuucaaaucccuuuucggcggcauguccugguucucccaaauccuuauaggaacccuucuaauguggcucggccucaacaccaaaaacggcuccauaucccucaugugccucgcccucggcggcguacuaaucuuccuaagcacagccgucagcgccgacgucggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7201 - RNA, 2503 nt, Artificial Sequence
  ZIKV prME variant mRNA Design 2 opt
ggggcgcugccuacggagguggcagccaucuccuucucggcaucaagcuuaccaugaucaucaacgcccgaaaagaaaagaaacgacgaggcgccgacacaagcguaggcaucguaggacuccugcucacuacagccauggcagcagaagugacccgccgcggauccgccuacuacauguaccucgaccgcaacgacgccggagaggcaauaucauuccccaccacgcuaggaaugaacaaaugcuacauacaaauaauggaucucggacacaugugcgacgccaccaugagcuacgaauguccaaugcuagacgagggaguugaacccgaugacguagacugcuggugcaacaccacaucgaccugggucgucuacgguaccugccaccacaagaaaggcgaagcccgacgcucacgccgagccgucacucuacccagccacuccacaagaaaacuccaaacacgcagccaaacauggcuagaaucccgcgaauacacaaaacaccuaauacgaguagagaacuggaucuucagaaaccccggcuucgcgcucgcagcggccgccaucgcauggcucuuaggcuccagcaccagccagaaaguuaucuaccucguaaugauccuccucaucgccccagccuacuccauccgaugcauuggaguaagcaacagggacuucguagaaggaaugagcggcggaacaugggucgacauaguacucgaacacggaggcugcguaaccguaauggcacaagacaaacccaccguggacauagaacucgucacaaccaccguuuccaacauggccgaagugagaagcuacuguuacgaagccagcaucucagacauggcuuccgauagcagaugccccacccaaggagaggcauaccucgauaaacaaucagacacccaauacgucugcaaaagaacacucguagaccgcgguuggggcaacggcugcggacucuuuggcaaaggaucccuaguuaccugcgcaaaauucgccugcagcaaaaagaugacgggcaagucaauacagcccgaaaaucuggaauaccggaucaugcuaucgguccacggcagccaacacagcggcaugaucgugaacgacaccggccacgaaaccgacgaaaacagagcaaaagucgagauaaccccaaacucaccccgagcagaagccacccuaggcggauucggcagccugggccuagacugcgaacccagaaccggccuagacuucuccgaccuguacuaccucacaaugaacaacaaacauugguuaguacacaaagaaugguuccacgacauaccucuaccauggcacgccggcgcagacaccgggaccccgcacuggaacaacaaggaagcacugguagaguucaaggacgcacacgcaaaacgccaaacggucgucgugcucggcagccaagaaggagccguccacaccgcgcuagcaggagcucucgaggcggaaauggacggcgccaaaggcaggcucuccucagggcaccucaaaugccgccucaaaauggacaaacuccgacucaaagguguguccuacucucucugcacagcagccuucacauucaccaagaucccugccgaaacacuccacgggacagucacgguagaaguccaauacgccgguacagacggaccgugcaaagucccagcccaaauggccguagacaugcagacacuuaccccagucggccgccucaucaccgccaaccccgucaucacagaaagcaccgaaaacucaaaaaugaugcuggaacucgacccacccuucggugacagcuacaucguaaucggaguaggagagaagaaaauaacacaccacuggcaucgcagcggcuccaccaucggcaaagcauucgaggcuacaguaagaggagccaaacgaauggccguccuaggagacaccgcaugggacuucgggagcgucggcggcgcacuaaacagccucggaaaagggauacaucaaaucuucggcgccgccuuuaaaucauuauucggcggcaugagcugguucagccaaauauuaaucggaacgcuacucauguggcuagggcucaacaccaaaaacggauccaucucacuaaugugccuggcucucggaggcguccucaucuuccuuucaacagcaguaagcgccgacguaggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7202 - RNA, 2500 nt, Artificial Sequence
  ZIKV prME variant mRNA Design 2 opt
ggggcgcugccuacggagguggcagccaucuccuucucggcaucaagcuuaccaugaucaacgcccgcaaagagaagaaacgcagaggcgccgacacgagcguaggaaucgucggccuacuacucacuacagccauggcggccgaggucacacgcagagggucagccuacuacauguaucucgacaggaacgacgccggagaagcgaucucauuccccaccacccucggaaugaacaaaugcuacauccaaauaauggaccucgggcacaugugcgacgcuacaauguccuaugagugcccuaugcuagacgaaggcguggaaccugacgacguagauugcuggugcaacacaacuucaaccuggguaguauacggcacaugccaccacaagaaaggagaggcacgcaggagccggcgcgccgucacgcucccaucacacuccacgcgaaaacuucaaacccggagccaaacuuggcuagaaagcagagaauacaccaaacaccucauaagaguagaaaacuggaucuuccgaaaccccggauucgcgcucgcagccgcagccaucgccuggcuacucggcucgagcacaagccaaaaagugaucuaccuaguaaugauacuccuaaucgcccccgccuacucaauccgaugcaucggaguaucaaaccgagacuucguagaaggaaugucaggaggaacuugggucgauauaguacuagaacacggaggcugcgucacggucauggcccaagacaaaccaacuguugacaucgaauuaguaaccacgaccgucagcaauauggcagaggugcgauccuacugcuacgaagccuccaucucggacauggcaagcgacucacgaugcccaacccagggagaggcguaccucgacaaacaaagcgacacacaguacguaugcaaaaggacgcuagucgaccgcggaugggggaacggaugcgggcucuuuggaaaaggcucgcucguaacaugcgccaaauucgcgugcaguaaaaagaugacaggcaagagcauacaaccagaaaaccuagaauaccggaucaugcucuccguccacggcucccaacacagcggaaugauagucaacgacaccggacacgaaaccgacgagaacagagcaaaagucgaaauaacacccaacagcccccgcgccgaagcaacccuaggaggguucgggagccucggccuggacugcgaaccacgcaccggacuagacuucagcgaccuauacuaccuaacaaugaacaauaaacacuggcuaguccacaaagagugguuucacgacauaccccugccauggcacgcaggagcugacaccggaaccccacacuggaacaacaaagaagcccuggucgaguucaaggacgcccacgccaaaagacaaacaguagucguacucggcucacaagaaggcgcgguacacacagcacucgccggcgcgcucgaagccgagauggacggcgccaagggcagauuaagcagcggccaccucaagugcaggcuaaaaauggacaaacuacgacugaagggcguaucauacucacucugcacagcugcauucacauucaccaagauaccagcggaaacacuacacgggacaguaaccguagaaguacaauacgccggcaccgacggccccuguaaggucccggcccaaauggcagucgacaugcagacccuaaccccugucggaagacugaucaccgccaacccaguaaucacagaaucaacagagaacucaaaaaugaugcuggaacuggacccgcccuucggagauagcuacaucgugaucggcgucggugaaaagaaaaucacgcaccacuggcacagaagcgggagcaccauagguaaagccuucgaggcgacaguuaggggcgccaaacgaauggcaguccucggcgacacagcaugggacuucggcagcgugggcggagcacucaacucacuagggaaaggaauccaccaaauauucggcgcagcauuuaaaagccuauucggaggaaugagcugguucucacagauccuaauuggcacacuacuaauguggcuagggcucaacaccaaaaacggaagcaucagccuuaugugccucgcacucgguggaguccuaauuuuucugagcaccgccgucagugcagacgugggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7203 - RNA, 2497 nt, Artificial Sequence
  ZIKV prME variant mRNA Design 2 opt
ggggcgcugccuacggagguggcagccaucuccuucucggcaucaagcuuaccaugaacgcacgcaaagaaaagaagcgccgcggagccgacacauccguaggaaucguaggacuacuccucacaacggccauggcagccgaaguaaccagacgcggcuccgccuacuacauguaccucgaccgaaacgacgcaggagaggcuaucucauuccccacaacccucggaaugaacaaaugcuauauacagauaauggaccugggccacaugugcgacgcaacaaugagcuacgaaugcccaauguuagaugaaggcguagaacccgacgacgucgacugcugguguaacaccacaucaaccuggguaguauacggcacaugccaccacaagaaaggcgaagcgcgcagaagccgucgagcagucacacuaccaucacacucaacacgaaaacuucagacccgaucacaaaccuggcuagaaucacgagaauauacgaaacaccucauccgaguagaaaacuggaucuucagaaaccccggcuucgcccuugcagcggcggccaucgccuggcuccuagggaguucaaccagccagaagguaaucuaccucgucaugauccuccucaucgcaccagccuacagcauccgaugcaucggcgucagcaacagagacuucguagaaggaaugagcggaggcacauggguagacauaguacucgaacacggcgggugcguaaccgugauggcacaagauaaacccacagucgacaucgaacuugugaccaccaccguaagcaacauggcagaaguaagguccuauugcuacgaagcaucaauuucugacauggcauccgacagccgaugcccaacgcagggagaagccuaccuagacaaacaaagcgacacccaauacguaugcaaacgaacgcugguagaccgcggcuggggcaacgguugcggacuauucgggaaaggaagccuagucacaugcgccaaauucgccugcagcaaaaagaugacaggcaaaucaauccaacccgaaaacuuggaauacagaaucaugcuauccguccacggaagccaacacuccggcaugauagucaacgacacgggacacgaaacagacgaaaaccgugcaaaaguagaaaucaccccgaauagcccaagagcggaagccacacuagggggcuuuggcagccucggccuagauugcgaaccacgaacagggcuagauuucucggaccuauacuauuuaaccaugaacaacaaacacuggcuaguucacaaagaaugguuccacgacauaccgcucccguggcacgccggcgcagauacgggcaccccacacuggaacaacaaggaagcgcugguagaguucaaagaugcucacgccaaacgccaaaccgucguaguacuaggcucacaggaaggugcaguacacaccgcacuagccggagcacucgaagccgaaauggacggagcaaaaggacgacucagcagcggacaucuaaaaugucgacucaaaauggacaaacucaggcucaagggagucagcuacagccuaugcacggccgcauucacauucaccaaaauaccggcagaaacacuccacgguaccguaacaguagagguccaauacgccggcaccgacggccccugcaaaguaccagcacaaauggcaguagacaugcaaacccucacccccguaggacgacuaauaacggccaacccaguaauaacugaaagcaccgaaaacaguaagaugaugcuagaacuggacccaccauucggugacucauacaucgucaucggcguaggcgaaaagaaaauaacccaccacuggcaccgaagcgggucaaccauaggaaaagccuucgaagcgacagugcgcggagccaaacgcauggccguacugggcgacacagcaugggacuucggaucaguaggcggcgcccucaacagccucggcaaagggauccaccaaaucuucggagccgcguuuaaaucgcuauucggcggcauguccugguucucccaaauccucaucggcacccuacucauguggcuuggccuaaacaccaaaaauggcucaaucagccucaugugccuagcacucggaggcguccugaucuuccugucaacagcggucucggcagacgucggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7204 - RNA, 2494 nt, Artificial Sequence
  ZIKV prME variant mRNA Design 2 opt
ggggcgcugccuacggagguggcagccaucuccuucucggcaucaagcuuaccauggcacgcaaggaaaagaagcgccgcggagcagacaccucagucggaauagucggccugcuacucaccaccgccauggcggcggaaguaacccgccgggggucagccuauuacauguaccucgaccgcaacgacgcaggcgaagccaucucauuccccaccacgcuaggcaugaacaaaugcuacauccaaauaauggaccucggccacaugugcgacgccaccaugagcuacgaaugcccaaugcuagacgaaggcguagaacccgacgacgucgauugcuggugcaacacaacaucaacauggguugucuacggaaccugccaccauaagaaaggcgaagcacgacgcagccgcagagcaguuacacuacccucccacucgacaagaaaauuacaaacacgaucacaaaccuggcucgaaucacgagaauacaccaaacaccuaauccgcgucgaaaacuggauauuccgaaaucccggauucgcucuagcagcagccgcgaucgccuggcugcucggcuccuccacaucccaaaaagucauuuaccucgucaugauccuauuaaucgcaccggccuacucaauacgcugcauaggaguauccaacagagacuucgucgaagggaugucaggcggcaccuggguagacaucguacuagaacacggcggcugugucaccguaauggcccaagacaaaccaaccgucgacaucgaacucgucacgaccaccguaagcaacauggccgaaguacgcuccuauugcuacgaagcaagcauaucagauauggcaagcgacucccgcugcccaacacagggcgaagcauaccuggacaaacaaagugacacccaauacgucuguaagcggacccucgucgaccgcggauggggcaacggcugcggccucuucggaaaaggaucccuaguaacaugcgccaaauucgcaugcuccaagaaaaugaccggcaaguccauacaaccagaaaaccuagaauaccggaucaugcuaaguguacacggcagccaacauuccggaaugauagucaacgacacagggcacgaaaccgacgaaaaccgagcaaaaguagaaauaaccccaaacucccccagagcagaagccacacuaggcggcuuuggcucucuaggccucgacugcgaaccaagaacaggucuagacuucucagaccuuuacuaccuaacaaugaacaacaaacacuggcucguacacaaagaaugguuccacgacaucccauugccauggcacgcaggagcagacacaggaacaccccacuggaacaacaaagaagcgcuagucgaguucaaagacgcacacgccaagagacaaaccguaguaguccucggcucacaagaaggugccguccacaccgcacuagcaggcgcacuagaagccgaaauggacggagcaaaaggacgacuauccucaggacaccuaaaaugccgucucaaaauggauaaacuaagacugaaaggcguaucauacucacucugcacagcagccuucacguucaccaaaauccccgccgaaacacuacacggcacagucacaguagaaguacaauacgccggcaccgacggucccugcaagguaccagcucaaauggcggucgacaugcaaacccuaacccccguagguagacucaucacugcaaaccccgugaucaccgaaucaaccgaaaacucaaaaaugaugcuggaacuagacccaccguucggcgacagcuacauagucaucggaguaggggagaaaaagauaacccaccacuggcacagaaguggaucgaccaucggcaaagccuucgaagcaacaguucgaggcgccaaaagaauggcaguccucggagacaccgcgugggacuucggcuccguaggcggagcccucaacucccucggcaagggaauacaucagaucuucggcgccgccuucaagagccuuuucggaggaaugagcugguucucacaaauccuaauaggcacacuacucauguggcucggccucaacaccaaaaacggguccaucucccuuaugugccuggcacugggcggaguacucauuuuccucagcacugccgucagcgccgacgucggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7205 - RNA, 2491 nt, Artificial Sequence
  ZIKV prME variant mRNA Design 2 opt
ggggcgcugccuacggagguggcagccaucuccuucucggcaucaagcuuaccaugagaaaagaaaaaaaacgccgaggagcagacacaagcgucggcaucguaggauuacuacugacaaccgcgauggcagccgaagucacaagacgaggcucagcauacuacauguaccucgaccgcaacgacgcaggugaagcaauaagcuucccgacgacucuaggaaugaacaaaugcuauauucaaauaauggaccuaggacacaugugcgacgcaaccaugagcuacgaaugccccaugcuagacgagggugucgaacccgacgacguagacugcuggugcaacaccacaagcaccugggucgucuacggcacaugccaccacaaaaaaggagaggcacgcagaagcagaagagcagucacgcuccccucccacagcacaagaaaacuacaaaccagaucccaaaccuggcuggagucgagagaauacacaaaacaccucauaaggguagaaaacuggaucuucagaaacccgggauucgcccuagcggcagccgccaucgcauggcuccugggcucaaguacuagccagaaagugauauaccuaguaaugauacugcuaauagcacccgccuacucaauccgcugcaucggcgucucaaaccgagacuucgucgaagguaugagcggcgguacauggguagacaucguacuagaacauggcggaugcgucaccgucauggcacaggacaaacccacaguggacaucgaacuggucaccacaaccgucucuaacauggcagagguacgcuccuacugcuacgaagccucaaucucagacauggcgagcgacucccgcugucccacccagggcgaagccuaccuggacaaacaauccgauacacaauacgugugcaaacgcacacucguugaccgagggugggggaacgguugcggccucuucggcaaaggcagccuggugaccugcgcaaaauucgcgugcucgaaaaaaaugacaggcaagagcauacaaccagaaaaccuagaguaccggaucaugcuaucaguccacggaucgcaacacucaggaaugauagucaacgauacaggacaugaaaccgacgaaaaccgagcgaaaguagaaaucacacccaacagcccgcgcgccgaagcaacacuagggggcuucggaagccucggacuagacugcgaaccacgcaccggccuagacuucagcgaccuuuacuaccuaaccaugaacaacaaacacuggcuaguccacaaagaaugguuccaugacaucccgcuaccguggcacgcuggcgcagacacggggaccccacauuggaacaauaaagaagcacuagucgaauucaaagacgcgcacgcaaaacggcaaacagucgucguacuaggcagccaagagggagcuguccauaccgcgcuagccggagcccuagaagcagaaauggacggagcaaaaggccgccuuagcuccggccaccucaaaugucggcuuaagauggacaaacucagacucaagggcgucagcuacagccucugcaccgcagccuucacauucaccaaaaucccggccgaaacccuacacggaacaguaacaguagaggugcaauacgcgggaacagacgguccaugcaaagucccagcccaaauggcuguagacaugcaaacccuuaccccgguagggagacuaauaacagccaaccccguaauuacugaaucaacagaaaacagcaaaaugaugcucgaacucgacccacccuucggcgauagcuacauaguaaucggggucggagaaaaaaaaauaacacaccacuggcacagaucaggauccacaauaggaaaagcauucgaagccaccguuaggggagcaaaacgaauggcaguacucggcgacaccgccugggacuucggcagcguaggcggcgcccuaaacagccucggaaaaggaauccaccaaauauucggugcagcauucaaaagccucuucggcggcaugagcugguucagccaaauacucaucggcacgcuccuaauguggcuaggacuaaauacaaaaaacggcaguaucagccuaaugugccucgcgcuagggggcguccuaaucuuccucucaacagcagucagcgccgacgucggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7206 - RNA, 2488 nt, Artificial Sequence
  ZIKV prME variant mRNA Design 2 opt
ggggcgcugccuacggagguggcagccaucuccuucucggcaucaagcuuaccaugaaggaaaaaaaacgacgcggagcagacacaucagucggaaucguaggccuccuccugacaacagcaauggcugccgaaguaacgaggcggggaagcgcguacuacauguaccucgacagaaacgacgcaggcgaagccaucuccuucccaaccacauuaggaaugaauaaaugcuacauccaaauaauggaccucggacacaugugcgacgccacaaugucauacgaaugcccgaugcucgaugaaggcgucgaacccgaugacguagacugcuggugcaacacaacgagcacaugggucgucuacggaacaugccaccacaaaaaaggcgaggcccgacgaucacgccgagcagugacacuccccucccacagcacccgcaaauuacaaacgagaagccaaacauggcucgaaagccgcgaauauaccaaacaccugaucagaguggaaaacuggauauucaggaaccccggcuucgcccuggcagcagcagcaauagccuggcuacuuggcaguagcacaucccagaaagucaucuaccucgucaugauacuccucaucgcaccugcauacagcauccgaugcaucggcguguccaacagagacuucguagaaggcaugagcggcggaacaugggucgacauaguacucgaacacggcggcugcguaaccgugauggcucaagacaaacccacagucgacaucgagcuagucaccacgaccguaagcaacauggcagaaguacgcagcuacugcuaugaagccucgauauccgacauggcaucagacucccggugccccacccagggagaagcauaccucgacaaacaauccgacacccaguacguuuguaaacgcacacuagucgacagaggcuggggaaacggcugcggccuauuuggcaaaggcagccuggucacaugcgcaaaauucgccugcagcaaaaaaaugaccggaaaaagcauacaaccagaaaaccuggaauaccgcauaaugcuguccguccacggaagccaacacucaggcaugaucguaaacgacaccggccacgagaccgacgaaaacagagcaaaagucgaaaucacaccgaacagcccacgagccgaagcaacccucggaggguucggcucguuaggacucgacugcgaaccaagaaccggacucgacuucucagaccucuacuaccuaacaaugaacaacaaacacuggcucguccacaaagaaugguuccacgacauaccacucccauggcacgccggagccgacaccggcaccccacacuggaacaacaaagaagcccucgucgaauucaaagacgcccacgccaaacgacaaaccguaguaguccucggaagccaagaaggcgcuguacacacggcccucgcaggggcgcuggaagccgaaauggauggcgcaaaaggaagacuaagcuccggccaccuaaaaugccgucucaagauggacaaacugcgccucaaaggcgucucauauagccuaugcaccgccgcuuucacauucacaaaaauacccgccgaaacacuccacggcacaguaacagucgaaguacaauaugccggcacagacggcccaugcaaagucccagcccaaauggccgucgacaugcaaacccucacaccagucggccgccuaaucacagcaaaccccguaauaacagaaagcacagaaaacucaaaaaugaugcuagaacuggacccccccuucggcgauagcuacauagucaucggaguuggcgaaaaaaaaauaacacaccacuggcaccgcuccggcuccacgaucggcaaagcauucgaagcaacgguacgaggagcaaaaagaauggcaguacuaggagauacugcaugggacuucggcuccguggggggggcacuaaacucccuaggcaaaggcauccaccaaaucuucggcgcagccuucaaaucacucuucggcgggauguccugguucagccaaauccucaucggcacccuacuaauguggcuugggcuaaauacgaagaacggaagcauaucccucaugugccuagcacuaggcggcguccucaucuuccuuagcaccgcaguauccgcagacguaggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7207 - RNA, 2485 nt, Artificial Sequence
  ZIKV prME variant mRNA Design 2 opt
ggggcgcugccuacggagguggcagccaucuccuucucggcaucaagcuuaccauggaaaagaaaagacgaggagcagacaccagcgucggcaucgucggucuacuacucacaacagccauggccgcagaagugaccagacggggaucggcauacuacauguaccucgaccguaacgacgcaggagaagcaaucucauucccaaccacacucggcaugaacaaaugcuacauccaaauaauggacuuaggacacaugugcgacgccacgauguccuacgaaugcccgaugcuagaugaaggaguggaacccgacgacgucgacugcuggugcaacaccacgagcacguggguaguauacggaacaugucaccacaaaaagggugaagccagacgcucccgacgggcggucacccuucccucacacagcacaagaaaacugcaaacucgcagccaaacauggcuggaaucacgcgaauacacaaaacaccuuauacgggucgaaaacuggaucuuccgaaacccaggauucgcacuagcagcggccgccauagccuggcuacuaggcagcaguacuucacaaaaaguaauauaccuagucaugauacuccugauagcccccgcuuacuccauccgaugcaucggaguaagcaauagagauuucguugaaggaaugucaggaggaacauggguagacauaguccucgagcacggcggcugcguaaccgucauggcacaggacaaaccaaccguggacauagaacuggucacaacaacugucagcaacauggccgagguacgcaguuacugcuacgaggcauccaucuccgacauggcaucggacagccgaugcccgacccaaggagaggcauaccucgacaaacaaagcgacacgcaauauguauguaaacgaaccuuaguagaccgcggauggggcaacgguugcggacucuucggaaaaggcucccuggucacaugcgcaaaguucgccugcuccaagaaaaugacgggaaaaagcauccaaccggaaaaccuagaguaccgaaucaugcugucuguccacggaucccagcauuccggcaugaucgucaacgacacuggacacgaaacagacgaaaaccgagccaaaguggagauaaccccaaacagcccaagagcagaggcaacccuaggaggauucggaucccuaggacuggacugcgaaccgcgcacuggacucgacuucucagaccuauacuaccuuacaaugaacaacaaacacuggcucguccacaaagagugguuccacgauaucccccuacccuggcacgccggcgcagacacaggaacaccacacuggaacaacaaagaagcccuagucgaguucaaagacgcgcacgccaaacggcaaacaguagucguccucggaagccaagaaggggcuguacauaccgcacucgccggcgcccuagaagccgaaauggacggcgcgaaaggacgacuaagcucaggacaccucaaaugccggcucaaaauggacaaacucagacucaaaggaguuuccuacucccuaugcacagcagccuuuaccuucaccaaaauacccgcggaaacccuccacggaaccgucacagucgaaguccaauaugcgggaaccgacgggcccugcaaagugcccgcccaaauggccgucgauaugcaaacccucacccccguaggccgacuaaucacagccaaccccguaauaaccgagucaacagaaaacuccaaaaugaugcuagaacuagaucccccauucggagacagcuacauaguaaucggcguaggcgaaaagaaaaucacccaccacuggcaccgauccggaagcacaaucggaaaagccuucgaagcaaccguccguggcgccaaaagaauggccguacuuggagacacagcaugggacuucgggagcgucggaggagcacugaacagccucggaaaaggaauccaccaaaucuucggcgcagcguucaagagccuauucggcgggaugagcugguucucacaaauacuaaucggaacacugcucauguggcuaggccuaaacaccaaaaacggaucaaucagccucaugugucucgcgcugggaggaguacugaucuuccuaucaacagccguaagugccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7208 - RNA, 2482 nt, Artificial Sequence
  ZIKV prME variant mRNA Design 2 opt
ggggcgcugccuacggagguggcagccaucuccuucucggcaucaagcuuaccaugaaaaaaagacggggugccgacaccucgguaggaauaguaggacuccuacucaccaccgccauggcagcagaaguaacacgccgaggcagcgccuacuauauguaccucgacagaaacgacgccggcgaagccaucuccuuccccaccacacucggcaugaacaaauguuacauccaaauaauggaucucggccacaugugcgacgcaaccaugucauacgagugcccaaugcucgacgaaggagucgaacccgaugacguagacugcuggugcaauaccaccuccacaugggucguauacggaacuugccaccauaaaaaaggagaagcaagacgaucacggagagccgucaccuuacccagccauuccacccggaaacuacaaaccagaagccaaacguggcucgagagccgggaauauacaaaacaccucauaagagucgaaaauuggauauucagaaaccccggauucgcccucgccgccgcagccauagccuggcuacucggauccagcacaagccagaaagucauauaccucgucaugauacugcuaauugccccagcuuauuccauccggugcauaggcgucaguaaccgggacuucguagaaggaaugucaggagggaccuggguagacaucgugcuagaacacggaggcugcguaaccgucauggcacaagacaaaccaacagucgacauagaacugguaaccacuacagucagcaacauggccgaaguacgaucauacugcuaugaagcaucaaucagcgacauggcaagcgacagucgaugccccacgcagggcgaagccuaccuagacaaacaaucagacacacaauacgugugcaaacggacacuugucgacagaggguggggaaacggcugcggccuauucgggaaaggcagccuaguaaccugcgcgaaauucgcgugcucaaaaaaaaugaccggcaaaagcauccagccagaaaaccuagaauacaggaucaugcucagcguccacggcagccagcacagcgguaugauagucaacgacacuggccacgaaacagacgagaaccgcgcaaaaguggaaaucacaccaaacucaccacgcgccgaagcaacccucgguggguucggcucccuuggacuagacugugaaccaagaaccggccucgacuucagcgaccuauacuaccucacaaugaacaacaaacacuggcucguccacaaagaaugguuccacgacauaccccuaccauggcacgcaggcgcagacacagggacuccacacuggaacaauaaggaagcgcuagucgaauucaaagacgcccacgcaaaaagacaaaccguggucguccugggaucccaagaaggagcagugcacaccgcccucgcaggcgcucucgaagccgagauggauggagcaaaaggaagacuaagcagcgggcaccucaaaugccgacuaaaaauggacaaacuaagacuaaaaggcgucagcuacagcuuauguacggccgccuucaccuucacgaaaaucccugccgaaacccuacacggcaccguaaccgucgaaguccaauacgccggaacagacgggccguguaaaguccccgcccagauggcaguagauaugcaaacacucacccccguaggacgccuaaucacggcaaaccccgucauaaccgaaagcacagaaaacucaaaaaugaugcucgaacuagauccccccuucggagacagcuacauaguaauaggaguaggagaaaaaaaaaucacccaccacuggcacagaucaggaaguaccaucggcaaggccuucgaagccaccgucagaggagccaaacgaauggcgguccucggagacaccgccugggacuucggaagcgucggcggcgcacucaacucacuaggcaaaggcauacaccaaaucuucggagccgccuucaaaagccucuucggcggaaugagcugguucucccaaauacuaaucggcacccuacucauguggcucggucucaacaccaaaaacggcuccauaucccucaugugccuagcacucggaggcguccucaucuuccugagcaccgccgucagugccgacguaggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7209 - RNA, 2479 nt, Artificial Sequence
  ZIKV prME variant mRNA Design 2 opt
ggggcgcugccuacggagguggcagccaucuccuucucggcaucaagcuuaccaugaagaggagaggcgcagauacgaguguagguauaguagggcucuugcucacgaccgcaauggcagccgaagucacaagaaggggcucggcauacuacauguaccuggacaggaacgacgccggcgaagcaauaucguucccaacaacgcuagggaugaauaaaugcuacauacagaucauggaucuagggcacaugugugacgccacaaugucauacgaaugcccgaugcuggaugaaggcguagagcccgacgacguggacugcuggugcaacacgacaagcacauggguagucuacggcacaugccaucacaagaaaggcgaagcgagaagaaguaggagagcaguaacacugccaagccacucaacccgcaagcuacaaacccgaagucagaccuggcuagaaucaagagaguacacaaaacaccugauaagaguagagaacuggauauuccgaaacccaggauucgccuuggcagccgcggcaauagccuggcuauuaggcucguccaccagccaaaaggucaucuaucucgugaugauacuacuaaucgcccccgcauacucaaucaggugcauaggagucagcaaccgcgacuuuguagaggggaugucgggcgggacauggguagacaucguacuagaacacgggggcugugucacagugauggcccaagacaaacccacgguagauaucgaacucgugaccacgacaguuagcaacauggcagaaguuagaucguacugcuacgaagccagcauaagcgacauggccucagacucgcgaugcccaacgcaaggggaggcauaccuggacaaacaaucagacacccaauacgucugcaaaagaacccuagucgaccgaggcuggggcaacgggugcgggcuauucggcaaaggcagccugguaacaugugcuaaauucgcaugcagcaaaaagaugacaggcaaaaguauacagccagagaaccuggaguacaggaucaugcuaagcguccacggcagccaacacagcggcaugaucgucaacgacacaggccacgaaacugacgaaaaccgagccaaaguagagauaacacccaacagcccgcgcgcagaggcaacacugggcggguucgggagccugggacuagacugcgaaccgagaacgggccuggacuucagcgaccucuacuacuuaaccaugaacaacaaacacuggcuaguccauaaagagugguuccacgacauaccacuaccauggcacgcaggcgcagacaccgggacaccacacuggaacaacaaagaagcccuggucgaguucaaggacgcacacgccaaaagacagacagucgugguccugggcucgcaagaaggagccguccacaccgcccucgcgggagcacuagaagccgagauggacggggccaaagggcgacugagcucgggacaucucaaaugccgccuaaagauggauaaacuccgccucaaaggcguaucauacagcuuaugcaccgcggcauucacauucacaaagauccccgccgagaccuugcacgggaccgugacaguagaagugcaauacgccggaacggauggaccaugcaaagucccagcacaaauggcagucgacaugcaaacccuaaccccaguaggacgccuaauaacggcaaaccccgucaucacagaaucaaccgaaaacuccaaaaugaugcuggaacuagacccaccguuuggcgauagcuacaucguaaucggaguaggagaaaagaaaaucacacaucacuggcaccgaagcggcagcacaaucggcaaagcauuugaagcaacaguacggggcgcaaaacgaauggcaguacuuggagacaccgcaugggauuucgggagcguaggaggggcccugaacucgcuagggaaaggaauccaccaaauauucggggccgcguucaagagccuuuucggaggaaugagcugguucagccaaauucucauagggacgcuccugauguggcucgggcuaaacaccaaaaacggcucaaucagcuuaaugugccuagcacuaggaggcguccuaauauuccuaagcacagccguaagcgcagacguaggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7210 - RNA, 2476 nt, Artificial Sequence
  ZIKV prME variant mRNA Design 2 opt
ggggcgcugccuacggagguggcagccaucuccuucucggcaucaagcuuaccaugcgccguggugcagacaccucaguaggaaucguaggccuucuccuaaccacagcuauggccgcagaagucacacgacggggaucggccuacuacauguaccucgaccgcaacgacgccggcgaagcaaucagcuucccaaccacccugggcaugaacaagugcuacauacaaauaauggaccucggccacaugugcgacgcaacgaugucauaugaaugccccaugcucgacgaaggaguagaacccgacgacguagacugcuggugcaacaccaccagcaccugggucgucuauggaaccugccaccacaagaaaggcgaggcccgcaggucccgacgcgccguaacgcuacccagccacucaacucgcaaacuacaaaccagaagccaaaccuggcuagaaucccgagaauacacgaaacaccucauaagagucgaaaacuggauauuccgcaacccaggcuucgcccuggcagcagcagcaaucgccuggcuccuaggcagcagcaccucccaaaaaguaauauaccuuguaaugauacugcucauagcacccgcauacagcauacgaugcaucggagucagcaacagagacuucgucgaaggcaugagcggaggcacauggguagacaucguccuagaacacggagggugcgucacgguaauggcacaggacaaaccaacagucgacaucgaacucguuaccacaaccguaagcaacauggcagaggucagauccuacugcuacgaagcauccauaagcgacauggcauccgacagccgaugcccaacccaaggcgaggcuuaccuagacaaacaauccgacacccaguacguaugcaagcgaacucuagucgauaggggauggggcaacggaugcggacucuucggcaaaggcuccuuagugacaugugcaaaauucgccuguagcaagaaaaugaccggcaaaagcauccaaccagaaaaccuggaguaccguauaaugcucagcguacacggaagccaacacagcggcaugauagucaacgacacaggacacgaaacagacgaaaaccgugccaaaguagaaaucaccccaaacagcccacgagcugaagccacccuaggaggcuucggaagccugggacuagacugcgaaccccgcaccggccucgacuucuccgacuuauacuaccugacaaugaacaacaaacacuggcuaguacacaaagagugguuccaugacaucccacuacccuggcacgcaggagccgacaccggcacaccgcacuggaauaauaaagaagcgcucguagaguucaaggacgcccacgccaagcgacaaaccgugguaguccugggcagccaagaaggagcaguccacaccgcccuagcaggagcacuagaagccgaaauggacggagcaaaagggcgacucagcucaggacaucucaaaugccgccugaaaauggacaaacuccggcucaagggagucagcuacagccugugcaccgcagccuucaccuucaccaaaauacccgcagaaacccuccacggcaccguaacaguagaaguccaauacgcaggaaccgacggacccugcaaaguaccagcccaaauggcaguagacaugcaaacacucacacccgucgguagauuaauaacagccaacccagucauaaccgaaucgacugaaaacaguaaaaugaugcucgagcuagaucccccauucggggacagcuacauaguaaucggagucggcgagaaaaagaucacacaucacuggcaccgcagcggcagcaccaucggcaaggcuuucgaagcaacaguacgcggggcaaaacggauggccguccuaggcgacacagccugggacuucggcuccguaggcggggcacucaacagccuagggaaaggcauccaccaaaucuucggagccgccuucaaaucgcuguucggaggaaugagcugguuuagucaaauacuuauaggcacccuacucauguggcucggacuaaauaccaaaaacgguuccaucagccucaugugccuagcccuaggcgggguacugaucuuccucucaaccgccgucuccgccgacguaggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7211 - RNA, 2473 nt, Artificial Sequence
  ZIKV prME variant mRNA Design 2 opt
ggggcgcugccuacggagguggcagccaucuccuucucggcaucaagcuuaccaugagaggagcugacacgagcgucggcauagucggacuccuccuaaccacagccauggcagccgaaguaacacgacguggauccgccuacuacauguaccuggacagaaacgaugcaggcgaagcuaucagcuuccccaccacccucggcaugaacaagugcuacauacagaucauggaccuaggccacaugugcgacgcgacgaugagcuacgaaugcccgaugcucgacgaaggcguggaacccgacgacgucgacugcuggugcaacacaaccagcaccuggguugucuacggcacgugccaccacaagaaaggagaagcacgccgaucccgcagagccguaacccuacccucacauuccacaagaaaacuacaaacccgaagccaaacauggcuagaaagccgcgaguacacaaaacaccuaauaagaguagaaaauuggauauuccgaaaccccgguuucgcccucgcagccgccgcgaucgccuggcuacuaggauccuccacuagccaaaaaguaaucuaccucgucaugauacuacucauagccccagccuacuccauccgcugcaucggagugucaaacagggacuucguagaaggcaugagcggaggcacgugggucgacaucguacuagaacacggcgggugcgucacagugauggcccaggacaaaccaaccguagacaucgagcuagucacgaccacaguaagcaacauggcugaagucagaucguacugcuacgaagccuccaucuccgacauggcauccgacucccgcugcccaacccaaggcgaagcauaccucgacaaacaaucggacacccaauauguaugcaaacgcacacucguagacagaggauggggcaacggcugcggacuauucggaaaagggagccuagucacuugugccaaauucgccugcagcaagaaaaugaccggaaaaaguauccaacccgaaaaccuagaauaccgcaucaugcucuccguccauggaucccaacacagcggcaugaucguaaacgacaccggccacgaaacagacgaaaaccgcgccaaagucgaaaucacccccaacuccccaagagcagaggccacccugggaggauucggaucacuaggccucgauugcgaaccgcggaccggccuagacuucucagaccuguauuaccuuaccaugaacaacaagcacuggcucguacacaaggaaugguuccacgauauaccacuacccuggcacgccggcgccgacacaggcacaccccacuggaacaacaaagaggccuuagucgaguucaaagacgcccacgcaaagcgucaaaccguagucguacuuggaucgcaagaaggcgccguccacaccgcccucgcaggggcccucgaagcagaaauggacggcgcgaaagggcgccuauccagcggacaccucaaaugcagacuaaaaauggauaaacuccgccugaaaggcgucucauacucccucugcaccgccgccuucaccuucacaaaaauccccgcagaaacccuccacgggacaguaaccgucgaaguccaguacgccggaacagacggacccugcaaaguaccugcgcaaauggcaguagacaugcaaacccuaacccccgugggacgacuaauaacggcaaacccagucauaaccgaauccacagaaaacucaaaaaugaugcucgagcucgacccacccuucggcgacagcuacaucgucaucggagucggagagaaaaagauaacacaccacuggcacagauccggcagcacgaucggcaaagcauucgaagccaccguacguggagcuaaacgcauggcaguccucggagauacagccugggacuucggcuccgucggaggcgcccucaacagccuaggcaaaggaauacaccaaauauucggugcagcauucaagucccucuucggcggcaugagcugguucucacagauccucauugggacccuacucauguggcuaggucuaaacaccaaaaacggcuccaucucccucaugugccuggcacuagguggcguacucaucuuccucucgaccgcgguuucagccgacgucgggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7212 - RNA, 2470 nt, Artificial Sequence
  ZIKV prME variant mRNA Design 2 opt
ggggcgcugccuacggagguggcagccaucuccuucucggcaucaagcuuaccaugggcgcggacacaagcgucgggaucguaggccuucugcucacgaccgccauggcagccgaagucacgcgacggggaucggccuacuacauguaccuugacagaaacgacgccggugaagcaauauccuucccuaccacccucggaaugaacaaauguuauauacagaucauggaccucggccacaugugcgacgcaaccaugucauacgaaugccccaugcuagacgaaggaguggagccagacgacguggacuguuggugcaacacaacgagcacauggguaguuuacggaacaugccaucacaagaaaggagaagcuagaagauccagacgcgcagucacacuaccaucccacagcacgcgcaaacuccagacacgcagccaaacauggcuggagucaagggaauacacaaaacaccucauacgagucgagaacuggaucuuccgcaaccccggauucgcacucgcagccgcagcaauagcauggcuucucgggagcuccaccagccaaaaaguaaucuaccucguaaugauacuccuaaucgcaccagcguacuccauaagaugcauaggcguaagcaaccgagacuucgucgaaggaaugagcgguggaacguggguugacaucguacuggaacacggggguugugucacggucauggcacaagacaaaccaacgguggacaucgagcuaguaacaacgaccgucagcaacauggcagaaguccgauccuacugcuacgaagcaucaaucagcgacauggccucagacucccgaugccccacccaaggagaagccuaccuagacaagcaauccgacacucaauacgucugcaaaagaacgcuagucgaccguggauggggaaacggcugcgggcuauuuggaaaaggaucucuagucacuugcgcaaaauucgcguguagcaagaaaaugacaggaaaaagcauacaaccggaaaauuuagaauacaggauaaugcucuccguccacggcucccaacauagcggcaugaucgucaacgacacaggucacgaaacagacgaaaacagggccaaaguagaaaucacccccaacucaccgcgcgcagaagcaacacugggcggcuucggcucacuaggccucgacugcgaaccacgcacuggcuuagacuucagcgaccucuacuaccugacaaugaacaauaaacacuggcuaguccacaaagaaugguuccacgacauaccgcuaccauggcaugcaggagcggacacaggcacaccacacuggaacaacaaagaagcccucgucgaguucaaagacgcccacgcaaaaagacaaacggucguaguccuaggcucccaagagggggcaguacacacagcacucgcaggagcacucgaagccgagauggacggagcgaaaggccgacuaucaucgggacaccucaaaugcaggcucaaaauggacaaacugcggcuaaaaggagucuccuacucacucugcacagcggccuucacuuucaccaaaaucccagccgaaacccuacacggcaccgucaccguggaaguacaauacgccggcaccgacggcccgugcaagguaccagcccaaauggccguagacaugcagaccuugaccccaguaggaagacuaaucacagccaacccggucauaacagaaagcaccgagaacuccaaaaugaugcuggaacuggacccacccuucggagacagcuauaucgucauaggaguuggagagaaaaagaucacccaccacuggcaccgaagcggaucaaccaucggcaaagccuucgaagccacaguccgaggcgcaaaaagaauggccguccuaggcgacacggccugggacuucgggaguguagguggagcacucaacucacucggaaaaggcauccaccaaauauucggggccgccuucaagagccuauucggaggcaugagcugguucucgcaaauacuaaucggcacacugcucaugugguuaggccuuaacacuaaaaacggcaguaucagccuaaugugccucgcacucggaggcgugcucauauuccugagcacagcagugagcgcggacgugggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7213 - RNA, 2467 nt, Artificial Sequence
  ZIKV prME variant mRNA Design 2 opt
ggggcgcugccuacggagguggcagccaucuccuucucggcaucaagcuuaccauggcagacaccagcgucggcauaguagggcuacuacucacaacagcaauggcagccgagguaacacggcgcggcucagccuauuacauguaccucgacagaaacgacgcaggagaagcaaucagcuuccccaccacgcuaggcaugaacaaaugcuacauacaaauaauggaccuaggccacaugugcgacgcuacaaugaguuacgaaugcccaaugcuggacgaaggcguagaaccagacgacgucgacugcuggugcaacaccacuagcaccugggucgucuacggaaccugccaccauaagaaaggggaagcgcgccgcagccggcgagcgguaacacuccccagccacagcacgcgcaaacuccagacccgcagccagacauggcuagaauccagagaauacaccaaacaccuaauaagaguagagaacuggaucuuccgcaacccaggauucgcccucgccgccgcagccauagccugguuauuaggcuccuccacaagccagaaaguaaucuaccucguaaugauacuccuaaucgcacccgcauauuccauaagaugcauaggcguaagcaaccgcgacuucguugaagggaugucgggcggaaccugggucgacaucgugcucgaacacggaggaugcgucacggucauggcccaagacaaacccaccgucgacaucgaguuagucacuacaacaguguccaacauggccgagguacgcuccuacugcuacgaagcaagcauauccgacauggccuccgacagucgcugcccaacacagggagaagcauaccucgacaaacagagcgacacacaauacguaugcaaacgaacccuaguagaccgaggauggggcaacggaugcggacuauucggcaaaggcucccuagugaccugcgcaaaauucgcaugcucaaagaaaaugacgggaaaaagcauacaaccagaaaaccucgaguaccgaauaaugcuaucgguccacggcagccaacacagcggaaugauaguaaacgauaccggacacgaaacagacgaaaacagagccaaaguagagauaacucccaacagcccacgagcugaagcgacucugggaggauucggcagccugggccucgacugugaaccgcgcaccggccuagacuucucagaucuuuauuaccucacuaugaauaacaaacauuggcucguacacaaagaaugguuccaugacauaccacuaccauggcacgccggagcagacaccggcaccccacacuggaacaacaaagaggcccucguagaguucaaagacgcccacgcgaaacgacaaacagucgugguucuaggcucacaagaaggagcgguccacaccgcgcuagcuggcgcacucgaagcagaaauggacggagcaaaaggacggcucagcuccggccaccucaaaugccgacuaaaaauggacaagcuccggcugaaaggagucagcuacucccucuguaccgccgccuucaccuucacaaaaaucccagcagaaacacuacacggcacaguaacaguagagguccaauacgcggggaccgacgguccaugcaagguaccagcccaaauggcaguagacaugcagacccuaacgcccguaggacgccugauaaccgcaaacccaguaauaaccgaaagcaccgaaaacagcaaaaugaugcuggaauuagacccgccauucggcgacagcuauaucgucauuggcgucggcgaaaagaaaaucacccaccacuggcaccgcaguggauccacaauaggaaaagcauucgaggcaaccguacgaggcgcaaaacgaauggccguccucggagauacagcgugggacuucggcuccgucggcggagcacucaacagccuagggaaagguauacaccaaauauucggcgcagcuuucaaaagccuauucggaggaaugagcugguucagccaaauacuaaucggcacacuccucauguggcucggacucaacaccaaaaacgggagcauaagccucaugugccuggcgcucggaggcguacucaucuuccucucaacggcaguaagcgcagacgugggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7214 - RNA, 2464 nt, Artificial Sequence
  ZIKV prME variant mRNA Design 2 opt
ggggcgcugccuacggagguggcagccaucuccuucucggcaucaagcuuaccauggacaccuccgucggcauagugggacuccuccuuacuaccgccauggcagcggaaguaacccgacgcggcucagcauacuacauguaccuggaccgcaacgacgcaggcgaggccaucagcuuucccaccacccugggaaugaacaaguguuacauacaaaucauggaccucggccacaugugcgacgcaaccaugagcuacgaaugcccaaugcucgacgaaggaguagaacccgacgacguagacugcuggugcaacacaaccucgacaugggucguauacggaaccugccaccacaagaaaggcgaggcccgccguucacgccgagccgucacacuaccaucccacuccacaagaaaauuacaaacgcgcucacaaacauggcucgaguccagagaauacaccaaacaccuaauccgaguagaaaacuggaucuuccgaaaccccggcuucgcccucgccgcagccgcaauagcguggcuccucgguuccagcaccucccaaaaagucaucuaccuaguaaugauacuacuaaucgcuccagcuuacuccauaagaugcauaggcguauccaaccgggacuucgucgaaggcaugaguggcggcacaugggucgacaucguccuagagcacgggggcugcguaacagucauggcccaagacaaaccaacggucgacauagaacucgucaccaccacagucucaaacauggcagaaguccgcuccuacugcuacgaagcgagcaucagugacauggcaucagacagccgcugcccaacccaaggagaagccuaccuagacaaacaauccgauacucaauacgucugcaaaagaacauuaguggacagaggcuggggaaacggcugcggccucuuuggaaaaggcagccuaguaacaugcgccaaauucgcuugcucuaagaaaaugaccggcaaaucaauccaacccgaaaaccuggaguaucgcaucaugcuaagcguacacggcagccaacacagcggaaugauaguuaaugacaccggccacgaaacagacgaaaaccgcgcaaaagucgaaaucacccccaacucaccccgcgcagaagccacccuaggcgguuucggcucacucggcuuagacugcgaaccacguacaggacuagacuucucagaccuguacuaccucaccaugaauaacaagcacuggcucguccacaaagaaugguuccacgacauaccccugccauggcacgcgggagcggacaccggcacaccccacuggaacaacaaagaagcccuaguggaguucaaagacgcccacgcaaaacgccaaaccguagucguucucggaagucaggaaggggccguccacacagcccuagccggagcccucgaagcagaaauggacggugcgaaagggcgacucuccucuggacaccucaaaugccgcuuaaaaauggacaaacuacggcucaaaggagucuccuacagccucugcacggccgccuucaccuucacaaaaauccccgccgaaacacuccacggaacagucacaguagaaguccaauacgccggaaccgacggccccugcaaagucccagcacaaauggcagucgacaugcaaacacucacacccguaggcagacucaucaccgccaacccagucauaacagaaucaacagaaaauuccaagaugaugcuggaacucgaucccccauucggcgacucauauaucgucauaggagugggagaaaagaaaaucacacaccacuggcaucgcucaggaagcaccaucggcaaagcauucgaagcuaccguccgaggagcgaaacggauggccguacuaggcgacacggccugggacuucggcuccguaggcggagcccucaauucccuagggaaaggcauccaccaaaucuucggcgccgccuucaaaucccuauucggcggcauguccugguucagccaaauacuaaucggaacacuacucauguggcuaggacucaacaccaaaaacggcuccaucagccucaugugccuagcucugggcggaguccucaucuuccucagcaccgcuguauccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7215 - RNA, 2461 nt, Artificial Sequence
  ZIKV prME variant mRNA Design 2 opt
ggggcgcugccuacggagguggcagccaucuccuucucggcaucaagcuuaccaugaccagcgucgguaucguaggccuacuacuaacgaccgcaauggcugccgaaguaacaagacgcggcagcgcguacuacauguaccucgaccgaaacgacgcaggcgaagcaaucagcuucccgaccacacuaggcaugaacaaaugcuacauacaaauaauggaccucggucauaugugcgacgcaacaaugaguuacgaaugcccaaugcucgacgaaggaguagagcccgacgacgucgacugcuggugcaacaccaccagcacaugggucgucuacggaacgugccaccacaagaaaggcgaagcccgcagaucccgccgcgcagucacccuccccagccacucaacgagaaaacuccagacccggucacaaacguggcucgaaucccgagaguacacaaaacaccucauacgcguggaaaauuggaucuuccgcaaccccggcuucgcacucgccgcagccgccauagccuggcuacucggauccucaacaucccaaaaagucauauacuuaguaaugauccuacucauagcaccagcuuacagcauccgcugcauaggcguauccaacagagacuucgucgaaggaaugagcggcggaaccuggguagacauaguccuggaacacgggggaugcguaaccgugauggcacaggacaaacccacagucgacauagaacucgugacaacaacgguaaguaacauggcggaaguucgcagcuacugcuacgaagccucaaucuccgacauggcaagcgacucacggugcccaacgcagggcgaagccuaccuagacaaacagucagauacacaauacgucugcaaacgaacccucguagaccggggcuggggcaacggaugcggccucuucggaaaaggaucacucgucacaugcgcaaaguucgcaugcaguaagaagaugacgggcaaaagcauccagccagagaaccucgaauaccgcauuaugcucucaguccacggaucccaacacucaggcaugaucgugaacgacacaggacacgaaacagacgaaaaccgagcgaaaguagaaauaaccccaaacagccccagagcagaagcaacccucggcggcuucggcagucucggacuagacugcgaaccaagaacaggccucgacuucagcgaucuguacuaccuaacgaugaacaacaaacacuggcucguacacaaagaaugguuccacgacauaccacucccguggcacgcaggagcagacacgggcacaccccauuggaacaacaaagaggcccuagucgaguucaaggacgcccacgccaaacggcagaccgucgugguacuaggcucacaagaaggagcagugcacacagcacuagcaggagcacuugaggcagaaauggacggcgccaaaggucgacugucaagcgggcaccuaaaaugucgccuaaaaauggacaaacuacgccucaaaggcguaagcuauagccucugcaccgcagcguucacguucacgaaaauaccggcagagacccuacacggcacaguaacgguugaaguccaauacgccggcaccgacgggccaugcaaagucccggcccaaauggccgucgacaugcaaacgcuaacaccggucggacgccucaucacagccaacccggucaucacagaaagcacagagaacaguaaaaugaugcuagaacuagacccacccuucggcgacucauacaucguaauaggcguaggagagaagaaaauaacccaccacuggcacagaagcggcaguaccauaggcaaagcauucgaagcaaccguaagaggcgccaaacgcauggcaguacuaggcgacaccgccugggacuucggcagcguaggaggagcccuaaacucccucggcaaaggcauacaccaaauauucggcgcagccuucaaaagccucuucggcgggaugagcugguucucccagauacuaauaggcacccuacuuauguggcuaggacuaaacaccaaaaacggaagcaucagccucaugugccucgcacucggcggaguacuaaucuuccucuccacagcggucucagcagacgucggcuguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7216 - RNA, 2461 nt, Artificial Sequence
  ZIKV prME variant mRNA Design 2 opt
ggggcgcugccuacggagguggcagccaucuccuucucggcaucaagcuuaccaugaccucaguuggaaucgucggccuacuucugacaaccgccauggcagccgccgucacacgcaggggcucagcauauuacauguaccuggaccgaaacgacgccggggaggccaucuccuuccccaccacccucgggaugaacaaaugcuacauccaaauaauggaccugggccacaugugcgacgcgaccauguccuacgagugccccaugcucgacgagggaguagaacccgacgaugucgacugcuggugcaacaccacgagcaccuggguggucuacggaacgugccaccacaagaaaggcgaagcccgacgcucccgcagggcggugacccuacccagccacagcacacggaaacuacaaaccaggucccagacauggcucgaguccagagaauacaccaaacaccuaauucgcgucgaaaacuggaucuucagaaacccaggauucgcccuagccgcagccgccaucgcauggcuccucggcucaagcacaagccaaaaagucaucuaccuagucaugauacugcuaaucgcccccgccuacucaauccgcugcaucggaguaucaaaucgcgauuucguugagggaaugagcggaggcaccugggucgacaucguccucgaacacggcggcugcguaacagucauggcucaagacaaaccaacaguagacaucgagcuaguaacaaccaccguaagcaacauggcagaaguacggucauacugcuacgaagcaucuauaucagacauggccucagacucacgaugcccaacucaaggggaagcauaucucgacaaacaaagcgacacccaauauguaugcaaacgaacacucguugacagaggcuggggaaacggcuguggccucuucggcaaaggcucccuugucacaugcgcaaaauucgccugcucgaagaaaaugaccggcaaaagcauacaaccagaaaaccuggaauacagaauaaugcugagcguacacggcucgcaacauagcggcaugauaguaaaugacaccggacacgaaaccgacgaaaaccgagccaaaguagaaaucacccccaauucuccccgcgccgaagccacucugggaggcuucggaucccuaggccucgacugcgaaccaagaaccggacuagacuucucagaccuauacuaccuaacaaugaacaacaaacacuggcuuguccacaaagaaugguuccacgacaucccccuacccuggcacgcaggcgccgacacaggaacgccccacuggaacaacaaagaagcacucguagaguucaaagacgcccacgcgaaacgccaaaccguagucguccugggcucacaagaaggagcaguccacaccgcgcucgccggugcacucgaagcagaaauggacggcgccaaaggccgacuaagcuccggccaucuaaaaugccgucuaaaaauggacaaacuccgccuaaaaggagucagcuacucacuguguacagcagccuucaccuucaccaaaaucccggccgagacgcuacacggcaccgucaccgucgaaguucaguacgcagggaccgacggacccugcaaaguccccgcccaaauggcgguagacaugcaaacccugaccccggucggaagacuuauaaccgcaaaccccguaaucaccgaaucaaccgagaacagcaaaaugaugcuggagcuagacccacccuucggcgacuccuacaucguaaucggcgucggcgaaaagaaaauaacccaccacuggcaccgaucgggaucaaccauaggaaaagcguucgaagcaaccguccgcggagcaaaacggauggccgugcuaggagacacagcaugggacuucggaagcguaggaggcgccuuaaacucacuaggcaaaggcauacaccaaaucuucggcgccgccuucaagagcuuauucggaggcaugagcugguucucccaaauccuaaucggcacacuccucauguggcugggacucaacaccaaaaacgggagcauaucgcucaugugccucgcccuggguggcguccuaaucuuccuaucgacagccgucuccgccgacgucggcugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7217 - RNA, 2473 nt, Artificial Sequence
  ZIKV prME variant mRNA Design 2 opt
ggggcgcugccuacggagguggcagccaucuccuucucggcaucaagcuuaccaugcgcggcgccgacaccagcguaggcaucgucggacuacuccucaccacagccauggcagccgcaguaacacgacgaggaucagccuacuacauguaccuggacagaaaugacgccggcgaagccaucagcuuuccaacaacucucgguaugaacaagugcuacauacaaauaauggaccucggccacaugugcgacgcaacaaugagcuacgaaugccccaugcuagacgaaggggucgagcccgacgacguagacugcuggugcaacaccaccucaaccugggugguauacggaacaugccaccacaagaaaggcgaagcucgacgcagcagacgagccguaacacucccaagccacagcacaagaaaacuccaaaccagaagccaaacauggcucgaauccagagaauacacaaaacaccuaauuagaguagaaaacuggauauucagaaaccccgguuucgcacucgccgccgccgcaauagcauggcuacucggaagcuccaccucgcaaaaagugaucuaccucgucaugauccuacuaaucgcaccagccuacuccaucagaugcaucggagucuccaaccgagacuucgucgaaggaaugagcggcggaaccuggguagacaucgugcuagaacacggcggaugcgucacuguaauggcacaagacaaaccaacagucgacaucgaacucguaaccacaacggucuccaacauggccgaaguccgauccuacuguuacgaggccagcauaucagauauggcauccgacagccgaugccccacccaaggcgaagccuaccuagacaaacaaagcgacacccaauacguaugcaaacgcacccucguugacagaggcuggggaaacggaugcgggcuauucggcaagggcucacucgucacaugcgccaaauucgccugcagcaaaaagaugaccgggaaaagcauacaacccgaaaaccuagaauaccgaaucaugcuaucagugcacgggucacagcauagcggcaugaucgucaacgacaccggacacgagacggacgaaaacagggccaaagucgagaucacccccaacucaccgcgcgcagaagccacgcucggcggauucggcucauuaggacuggauugcgaaccacguaccggccucgacuucuccgaccucuacuaccucacaaugaauaacaaacacuggcugguacacaaagaaugguuccacgacauaccccuacccuggcacgccggagccgacacaggcacaccgcacuggaacaacaaggaagcccucgucgaguucaaagacgcccacgcuaaaagacaaaccgucgucguacuaggaagccaagaaggcgcagugcacaccgcgcuggcgggcgcacuugaagccgaaauggauggagcaaaaggaagacuaagcuccggacaccugaaaugucgccuaaagauggacaaacuaaggcuaaaaggcguaucguacucacucugcacagcagcauucacuuucacaaaaauacccgccgaaacgcuccacggcaccguaacagucgaaguccaauacgcgggaaccgacggcccaugcaaaguccccgcccaaauggccguggacaugcagacccuaaccccggugggccgccuaauaacagcaaaccccguaaucacugaaagcaccgaaaauucaaaaaugaugcucgaacucgacccacccuucggagacagcuacauagugauaggaguaggagagaaaaagauuacccaccauuggcacagaucaggcagcacaaucggaaaggcuuucgaagcaaccguacgcggagcaaaacgcauggcgguacucggcgacacagccugggacuucggcagcgucggcggcgcacuaaacuccuuaggaaaggguauccaccaaaucuuuggcgcagccuucaaaagccucuucggcggcaugagcugguucucacaaauccucauaggcacacuccucauguggcucggcuuaaacaccaaaaacggauccaucagccuaaugugccuggcacucggcggcguccuaaucuuucuaucaacugccgucagugcagacguaggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7218 - RNA, 2497 nt, Artificial Sequence
  ZIKV prME variant mRNA Design 2 opt
ggggcgcugccuacggagguggcagccaucuccuucucggcaucaagcuuaccaugcgaggccucagcuccagaaaacgacgaucacacgacguccucacgguacaauuccucauacuagguaugcuacucaugaccggaggagugacacgcagaggcagcgccuacuacauguaccucgaccgcaacgacgcaggagaggccaucagcuuccccacaacccuaggcaugaauaaaugcuacauccaaaucauggaccuaggccacaugugcgacgccacaaugucauacgaaugccccaugcuugacgaaggaguagaacccgacgacguagacugcuggugcaacacaaccagcaccugggucguauacggaacgugccaccacaagaaaggugaagcacgaagaagccgaagggcagucacccuucccagccacucaaccagaaaacuccaaacacgaucccaaaccuggcuagagagccgcgaguauacgaaacaccucauccgcgucgaaaacuggaucuucagaaacccaggcuucgcgcucgcugcagcagcaauagcauggcuccugggaagcagcaccucgcaaaagguuauauaccuagucaugauacuacugauagcacccgccuacagcauacgcuguaucggaguauccaacagagacuucgucgaaggaauguccggaggaacauggguagauauagugcucgaacacggugggugcguaaccgucauggcccaggacaaacccaccgucgacauagaacucgucacaaccacgguaucaaacauggccgaaguacgaucauacugcuacgaagcaagcauuagcgacauggcguccgacucaaggugcccaacccaaggagaagcauaccuagacaaacaaagcgacacgcaauacgugugcaagcgaacccuuguagacagaggaugggggaacggaugcggccucuucggaaaaggcagccuaguaacaugcgcaaaauucgcaugcagcaagaaaaugaccggaaaaucgauacaaccagagaaccucgaauacagaauaaugcucagcguccacgguucacagcacagcggcaugauagugaacgacacagggcacgagaccgacgaaaaucgcgcuaaagucgagauaaccccaaacagcccacgagcagaagccacccucgggggcuucggaucacuuggacuagacugcgaaccacgaaccggacuagauuucagcgaccucuacuaccuaacaaugaacaacaaacacuggcucguacacaaagaaugguuccacgauaucccguuaccauggcacgcaggagccgacacaggaacuccccacuggaacaacaaagaagcacucguggaguucaaggacgcucacgcaaaacgccaaaccguggugguccuaggaagccaggaaggagccguucacacagccuuagccggagcacuagaagcggagauggacggggccaagggccgccugagcaguggacaccucaagugccgacugaaaauggacaaacuaagacuaaaaggagucucguacagccuaugcacagcagccuucaccuucacaaagauaccggccgaaacacuacacggcacagugacaguagaaguacaauacgcaggaaccgacggccccugcaaaguacccgcccaaauggcaguagacaugcaaacccucacacccguaggcaggcuaaucacggcgaacccaguuauaacggaaagcacggagaacagcaaaaugaugcuagagcuggacccaccauuuggagacucguacauaguaaucggagucggagaaaagaaaaucacacaccacuggcaccguuccggcagcacgauaggcaaggcguucgaagcaacagucagaggcgccaagaggauggcgguacucggagacaccgccugggacuucggcucagugggcggcgcgcuaaacucacucggaaaaggcauacaccaaauauucggagccgcauucaaaagucuuuucggaggcaugagcugguucagccaaauccugauaggcaccuuacuaauguggcucggcuuaaacaccaaaaacggaaguaucucacucaugugcuuagcccugggcggaguucucauauuccuuagcaccgcagucagcgccgacguugggugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7219 - RNA, 2497 nt, Artificial Sequence
  ZIKV prME variant mRNA Design 2 opt
ggggcgcugccuacggagguggcagccaucuccuucucggcaucaagcuuaccaugcgcggccucucuagccgcaaacgcagaagccacgacgucuuaacuguacaauucuuaauccucggcaugcugcuaaugacaggggcaguaacacgccgaggauccgcuuacuauauguaccuggaccggaacgacgcaggcgaagccauauccuucccaacaacccugggcaugaacaaaugcuacauacaaauaauggaccuaggucacaugugcgacgcgaccaugagcuacgagugccccaugcucgaugaaggagucgaacccgacgacgucgacugcuggugcaacaccacgucuaccuggguagucuacggaaccugccaccacaaaaagggagaagcacggcgaucuaggcgagcaguaacgcuaccaucacauagcacgcggaaacuccagacacgaucccaaaccugguuagaaagccgagaguacaccaaacaccugauaagaguagaaaacuggaucuucagaaacccaggauucgcucuagcggcagcagccaucgccuggcuccuuggaucaucaacaucucaaaaaguaaucuaccucguaaugauccuccucaucgcaccggcauacagcauacgcugcaucggcgucucaaacagagacuucguagaagggaugagcggcggcacauggguagacauaguacucgaacacggcggcugcguaaccguaauggcgcaggacaaaccaaccgucgacaucgagcuagucacgaccaccgucucaaacauggcugaaguccgaucauacugcuacgaagcaagcaucagcgauauggccuccgacaguagaugccccacccaaggagaagccuaccuugacaaacaauccgacacccaauacguaugcaagcgaacccucgucgaccgcggcuggggcaacggcugcggccuauucggcaaaggcagccucgucacaugcgccaaauucgccugcagcaagaaaaugaccggaaaaucaauacaaccagaaaaccucgaauaccgaaucaugcucagcguccacggcagccaacacuccggcaugauagucaacgacacaggccacgaaacagacgagaaccgugccaaaguagagauaacacccaacaguccccgugccgaagcaacccucggcggcuucggcucccuaggccuggacugcgaaccacgaaccggacuagacuucagcgaccuauacuaccuaacaaugaacaacaagcacuggcugguacacaaagaaugguuccacgacaucccccuccccuggcacgcgggcgccgacacgggaaccccacacuggaacaacaaagaagcccucgucgaguucaaagacgcgcacgcaaaaagacaaacagucgucguauuaggcucacaagaaggcgcaguacacacagcccuagcuggagcccucgaagcagaaauggacggggcaaaaggccgacucagcagcggacaccucaaaugccgccuuaaaauggacaaacuacgacuaaagggagucagcuacucacucugcaccgccgcauucacguucaccaaaauccccgccgaaacccuccacggaaccguaacaguagaaguacaauacgcaggcaccgacggucccugcaaagucccagcccaaauggcaguagacaugcagacacuaacgccuguagggagacuaauuacagcaaacccugucaucacggaaucaaccgagaacagcaaaaugaugcuagaacuagaucccccauucggagacaguuacaucguaauuggagucggagaaaagaagauaacgcaccacuggcacagaagcggcucaacaauaggaaaagcauucgaagccacaguccggggagccaagagaauggccguacugggggacaccgcaugggacuucggaagcgugggcggagcacuaaacagccuaggcaaagggauacaccaaauauucggcgccgccuucaaaucacucuucggaggcaugagcugguucagccagauucuuaucggcacacuacuaauguggcucggccugaacaccaaaaacgguagcauaucacucaugugccuugcccucggagguguacuaaucuuccugagcaccgccgucagcgcagacguaggaugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7220 - RNA, 2497 nt, Artificial Sequence
  ZIKV prME variant mRNA Design 2 opt
ggggcgcugccuacggagguggcagccaucuccuucucggcaucaagcuuaccaugcgaauaauaaacgcacgaaaagagaagaaaagaagaggcgccgacacaagcgugggaauagucggccuacugcuaacaacagccauggccgccgaagucacgcgucgaggauccgccuacuacauguaccucgaccgaaacgacgccggcgaagccauauccuucccaacaacccucggcaugaacaaaugcuacauccaaauaauggaccugggacacaugugcgacgccaccaugucauacgaaugcccaaugcuagacgaaggcgucgaaccagacgaugucgacugcuggugcaacacaacuagcacauggguaguauacggcacaugccaccacaagaaaggggaagcccgccgcagccggagggccgucaccuuaccaucccacucaacgcgcaaacuccaaacccgaagccaaacauggcucgaaucgcgagaauacaccaaacaccucauccgggucgagaacuggaucuuucgaaaccccggguucgcccuagcggcggcggcaauagcauggcuacucggcucaucaacgucucaaaaagucauuuaucuagucaugauacugcuaaucgccccagcguacucaauacggugcaucggaguaucaaaccgcgauuucguggagggcaugucaggcggaaccuggguagacauagugcuagagcacggaggcuguguuacugucauggcccaggacaaacccaccguggacaucgagcuaguaacaacaaccguauccaacauggcagaaguccguucauacugcuaugaagccuccaucuccgacauggcaucagauagcagaugcccaacacagggcgaagcauacuuagacaaacagucagacacgcaauacguuuguaaacgcaccuuagucgacagaggcugggggaacggaugcgggcuauucggcaagggcucgcuaguaaccugcgccaaauucgcaugcagcaagaagaugaccggcaaauccauacaaccagaaaaccucgaauacagaauaaugcuaucuguccacggcagccaacacagcggaaugauugucaacgacacaggccacgaaacggacgaaaaccgagccaaaguagaaaucacacccaacucaccgcgagccgaagcaacccucgggggcuucggcucccuaggacucgacugcgaaccccggaccggccucgacuucagcgaccucuacuaccuaaccaugaacaacaaacauuggcuaguccacaaagaaugguuccacgacaucccccuuccauggcaugcaggagcagacacaggcacaccccacuggaacaacaaagaagcgcuaguagaguucaaagacgcacacgcaaaacgacaaacagucgucgugcugggaucccaagaaggcgcuguccauacagcacucgcaggcgcacucgaagccgagauggauggcgcaaaaggacgacuaagcuccggacaccucaaaugcagacugaaaauggacaaacucagacuaaaaggagucucauacucccuaugcaccgccgcguucaccuucaccaaaauaccagcagaaacacuccacggaacggucaccgucgaaguacaauaugcaggcacagacggaccgugcaaagucccggcccaaauggcagucgauaugcaaacacuaaccccagucggccgccugaucacugcaaaccccguaaucacagaaagcacagaaaacuccaaaaugaugcucgaauuggacccacccuucggggauagcuacaucguaaucggcgucggcgaaaagaaaauaacacaccacuggcaccgcagugggagcacuauaggcaaagcauucgaagccaccguucgcggagccaaacgcauggccguacucggcgacacagccugggauuucggcucaguaggcggcgcccuaaacucccuagggaaaggcauccaucaaauauucggagcugcguucaaaagccuauucggaggaaugagcugguucucccaaauacucaucggcacacuacugauguggcucggccuaaacaccaaaaacggauccauaagccuaaugugccucgcacucggcggcgugcucaucuuccucagcacagccguaagcgcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7221 - RNA, 2494 nt, Artificial Sequence
  ZIKV prME variant mRNA Design 2 opt
ggggcgcugccuacggagguggcagccaucuccuucucggcaucaagcuuaccaugaucauaaacgcacgcaaggaaaagaaacgaagaggcgcugacacaagcgucgggauaguaggccuccugcuaaccaccgcaauggcagcagaagugacucgccguggcagcgcauacuacauguaccucgaccguaacgacgcaggggaagcaauaaguuuccccaccacacucggcaugaacaaaugcuacauccaaaucauggaccucggccacaugugcgacgccaccaugagcuacgagugccccaugcucgacgagggagucgaaccagacgacguagacugcugguguaacacgaccucaaccugggugguauacggaaccugccaccauaagaaaggagaagcccgccgaucccgacgcgcaguaacccuccccucacacuccacccgaaaacuacaaacacgcucacaaacauggcuggaaucacgcgaauacaccaaacaccucaucagaguagagaauuggaucuuccgcaaccccggcuucgccuuagcagccgccgccauagcauggcuacucgggagcucuaccagccaaaaggucauauaccuaguaaugauccugcuaaucgccccagcauacagcauacgcugcaucggcguauccaacagagacuucgucgaagguauguccggcggcacaugggucgacaucguccucgaacacggaggcugcgugaccgucauggcccaagauaaaccaaccgucgacauagaacucgucaccaccacaguaucaaacauggccgagguacgcucauacugcuacgaagcauccauauccgacauggcaagcgacucgaggugcccuacacagggcgaagccuaccuagacaaacaaucagacacacaauacgucuguaaacgcacccuagucgacagaggauggggaaacgggugcggccuauucgggaagggcagccugguaaccugcgcaaaauucgccugcagcaagaaaaugacuggaaaaucgauccaaccugaaaaccuggaauaccgaaucaugcuaagcguccacggaagccagcacucgggcaugaucgucaaugacacaggacacgaaacagacgaaaaucgcgcaaaaguagaaauaacccccaacucgcccagggccgaagccacgcucggcggcuucggaucgcuaggccuugacugcgagcccagaaccggacuagacuucucagaucuguacuaccuaaccaugaacaacaaacacuggcucgugcacaaagaaugguuucacgacauaccccucccauggcacgccggcgcagacacaggcacaccccacuggaacaacaaagaagcacucguagaguucaaagacgcccacgcaaaacgccaaacagucgucgugcuaggcucccaagaaggagccguccacacagcccucgccggcgcccuagaagccgaaauggacggagccaaaggacgacucucaagcgggcaucucaaaugcaggcuaaaaauggauaagcucagacuaaaaggagucagcuacucacuaugcaccgccgccuucaccuucaccaaaauacccgcggaaacacuacacggaacaguaaccgucgaaguccaauacgccggcaccgauggcccgugcaaaguccccgcucaaauggccgucgacaugcaaacauuaacgcccguaggccgccucaucacagcaaauccagucauaacggaaagcacagaaaacagcaaaaugaugcucgaacucgacccgcccuucggagacaguuacaucgucauuggcguaggcgaaaagaaaauaacacaccacuggcacagaagcggaucgaccauaggcaaagcauucgaagcaaccguccgaggcgccaaaagaauggccguacucggagauacagcaugggacuucggaucagucggcggagcccuaaacucccucggcaaagguauacaccaaaucuucggagccgccuucaaaagccucuucggaggcaugucgugguucagucaaauacucauaggaacacuacucauguggcuaggccuaaacaccaaaaacggcucuaucagccucaugugccuagcacuaggaggcguccuaaucuuccucagcacagcgguauccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7222 - RNA, 2491 nt, Artificial Sequence
  ZIKV prME variant mRNA Design 2 opt
ggggcgcugccuacggagguggcagccaucuccuucucggcaucaagcuuaccaugaucaacgcccggaaagaaaagaaaaggagaggcgcagacacaagcgucggcauagucggacuccuacucacaaccgccauggcggccgaagucacacggagaggaucggccuacuacauguaccuagaccgaaacgacgccggagaagccaucagcuuccccacaacacuaggaaugaacaaaugcuacauacaaauaauggaccuuggccauaugugcgacgccacaaugagcuaugaaugccccaugcucgacgaaggagucgagccggacgacgucgauugcuggugcaacaccacauccacaugggucgucuacggcacaugccaccacaagaaaggagaagccagacgcagcagacgagccguaacacuacccagccacucaacacgcaaacuccaaacccgaagccaaaccuggcucgagagcagagaauauaccaaacaccuaaucagggucgagaacuggauauucaggaacccaggauucgcacuagcugccgcagcaauagcauggcuacuaggcagcagcaccagccagaaagugaucuaccucguaaugauacuucucauagcacccgccuacucaauacgaugcauaggcgucagcaaccgcgacuucgucgaaggcaugucagguggaacauggguagacaucgugcucgaacacggcggcugcgucaccgucauggcccaagacaaacccaccguagacauagagcuagugaccacaacaguaagcaauauggccgaagugagaagcuacuguuacgaagccagcaucagcgacauggcguccgacucucgcugcccaacccaaggagaagcguaccuagacaaacaaagcgacacacaauacguaugcaaaaggacccucgucgaccgaggcuggggcaacggaugcggacuguucggcaaagggagccuaguaacaugcgcaaaauucgcgugcuccaagaaaaugacaggaaaaagcauacaaccagagaaccuagaauaccgcaucaugcuaagcguccacggaagccaacacucaggcaugauaguuaacgacacaggccacgagaccgaugagaaccgcgccaaaguggagaucacaccaaacuccccaagagcagaagcgacccuaggaggauucggaucgcucgggcucgacugcgagccaagaacaggccuagacuucuccgaccucuacuaccuaaccaugaacaauaaacauuggcuagugcacaaagaaugguuccacgacauaccgcucccauggcacgccggcgcugacacgggaacgccccacuggaacaauaaagaagcacuggucgaguucaaggacgcacacgccaaaagacaaaccgucguaguacucggaagccaagaaggcgccguacacaccgcacuggccggagcccuagaagcagaaauggacggcgcgaaaggaagacucagcucaggacaccugaagugccggcucaaaauggacaaacuccgacucaaaggaguaagcuacagccucugcacagccgccuucaccuucaccaagaucccggcagaaacccuucacggcaccgucacaguagaaguacaauacgcagguacagacggacccugcaagguccccgcacaaauggcaguagacaugcaaacccugacaccaguugggagacugaucaccgcaaacccagugaucaccgaaucaaccgaaaacagcaaaaugaugcuagaacucgacccaccauucggggacagcuacauaguaaucggcgugggagaaaagaaaauaacacaccacuggcaccgcucaggcaguacuauaggaaaagccuucgaggccacaguccguggggccaaaagaauggcgguacuaggcgacaccgccugggacuucggcagcguagggggcgcacuaaacucacucggaaaagggauucaccagauuuucggcgcagccuucaaaagccucuucggaggaaugagcugguucagccaaauacucauaggaacgcuacugauguggcugggccucaacaccaaaaacgggucaauaagccucaugugccuagcccuaggcggaguccuaauauuccuauccacagcagucagcgcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7223 - RNA, 2488 nt, Artificial Sequence
  ZIKV prME variant mRNA Design 2 opt
ggggcgcugccuacggagguggcagccaucuccuucucggcaucaagcuuaccaugaaugcacgaaaagaaaagaaacgacgaggagcagacacuucagucggcaucgugggccugcuacucacaacagcgauggccgccgaagucacacgccgaggcucugcuuacuacauguaccucgaucgaaacgacgccggggaagcaaucucguuccccaccacgcugggaaugaacaaauguuacauacaaaucauggaccucggccacaugugcgacgccaccauguccuacgaaugcccaaugcucgacgaaggaguagagccagacgacgucgacugcuggugcaacaccaccagcacguggguagucuacgggacgugccaccauaagaaaggagaagcacgcagaaguagacgagcagucacccuaccaagccacucaacccgcaaacuacaaaccagaucucaaacguggcucgaaagucgcgaguacacuaaacaccucauacgcgucgaaaacuggaucuuccgaaaucccggauucgcgcuggcagcagcagccauagccugguuacugggcagcuccaccagccaaaaaguaaucuaccuugugaugauccuacuaaucgcuccagccuacagcauccgaugcauaggcgucagcaaccgagacuucgucgagggcauguccggcggaaccuggguagacaucguacuagaacacggcgggugcgucacagucauggcacaagacaaacccaccgucgacauagagcuaguaaccacgacaguaagcaacauggcagaagucagaagcuacuguuacgaagcaucaauauccgacauggcaagcgacucccgaugccccacccaaggcgaagcauaccuagacaaacaaagcgacacccaguacgucugcaaaaggacccuagucgaccgaggcuggggaaacgggugcggacuguucgggaaaggcagccucguaaccugcgccaaauucgccugcucaaagaaaaugacgggcaaaagcauacaacccgaaaaccucgaauacaggaucaugcuaucuguccauggcagccaacacuccggcaugauagucaaugauacuggacacgaaacagacgaaaaccgcgccaaaguagaaaucacacccaacagcccccgcgcagaagcaacccucggaggcuucggaucccuaggccucgacugcgaaccacgcaccggccucgacuucuccgaucucuacuaccucaccaugaacaauaaacacuggcugguccacaaagaaugguuccacgacauaccccugccguggcacgccggcgccgacacaggaaccccacacuggaacaacaaagaggcgcuagucgaguucaaagacgcccacgcuaaacgacaaacggucgucguccuaggcucccaagaaggggcgguccacacagcccucgcaggagcccuggaagccgaaauggacggcgccaaaggcagacucagcuccggccaccuaaagugccgccucaaaauggacaaacuaagacugaaaggcgucagcuacagccuaugcacagcagcauucacauucaccaaaauacccgccgaaacccugcacggaacagugacaguagaaguccaauacgccggcaccgacgggcccugcaaaguaccagcccaaauggccgucgacaugcaaacgcucaccccagucggccgacugaucaccgccaacccagucaucaccgaauccacagagaacucaaaaaugaugcucgaacuagaucccccauucggcgacuccuacauaguuaucggcguuggagaaaagaaaaucacgcaccacuggcacaggagcgguucaacaauaggaaaagccuucgaagcgacaguccgcggagccaaacgaauggcgguacugggcgacacugcaugggacuucggcagcguaggcggcgcucucaacucccugggaaaaggaauacaucaaauauucggagccgcauuuaaaucacuguucggaggcaugucaugguucagccagauccuaauaggcacccuccucauguggcucggacuaaacacgaaaaauggaagcauaagccuuaugugccuagcacucggcggaguccuaauauuccucagcacggccgugagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7224 - RNA, 2485 nt, Artificial Sequence
  ZIKV prME variant mRNA Design 2 opt
ggggcgcugccuacggagguggcagccaucuccuucucggcaucaagcuuaccauggcccgaaaagaaaaaaaacgacgaggcgccgacacauccguaggaauagucggccuccuacuaaccacggcuauggcagccgaaguaacgcgccgaggaucagccuacuacauguacuuagacagaaacgacgcaggagaagcaaucagcuucccaaccacgcucggaaugaauaaaugcuacauccaaauaauggaccuaggccacaugugugacgccacuauguccuacgaaugccccaugcuagacgagggcgucgagccagacgacgucgauugcuggugcaacaccaccagcaccugggucguguacgggacaugccaccacaaaaaaggcgaagcacgacgaucccgccgagcagucacccugccaucccauagcacaagaaaacuccaaacccgcagccagacauggcuagaaagccgagaauacacaaaacaccucauccgaguggaaaacuggaucuuucgcaacccaggcuucgcacucgcagcagccgccaucgccuggcuccuaggcucgagcaccagccaaaaagucauauaccucgucaugauacuacucauagccccggcauacuccauccgaugcauuggagucagcaaccgggacuucgucgaaggaaugagcggcggcaccuggguagacaucgugcucgaacacggaggcugcguaaccgucauggcgcaggacaaacccacaguagauaucgaacuagucaccacuacaguaagcaacauggcggaaguacgaagcuacuguuacgaggccagcauauccgacauggcaucggacagcagaugccccacccaaggggaggcauaccucgacaaacaaucagacacgcaauacguaugcaaacggacccuggucgaucgcggauggggcaacgggugcggccucuucggcaaaggcucacucgucaccugcgccaaauucgcaugcuccaagaaaaugaccggcaaaagcauacaaccagagaaccuagaauaccgaaucaugcugucaguccacgguagccaacacagcggcaugaucgucaacgacaccggacacgaaaccgacgaaaauagagccaaaguagaaaucacgcccaacagcccaagagcagaagccacccucggcggguucgguagccuaggccuugacugcgagccgcgcacaggacuggacuucagcgaccucuacuaccugaccaugaacaauaaacacuggcucguacacaaagagugguuccacgacaucccccuacccuggcacgcaggagccgacaccggcacgccacauuggaacaacaaagaagcccucgucgaauucaaagacgcgcaugcgaaaagacagacagucguaguccuaggaucacaagaaggagcgguacauacagcacuagcaggagcgcucgaagcagaaauggacggcgcaaaaggacgacuaucgucaggccaccucaaaugccgacucaaaauggacaaacuaagacucaaaggggucagcuacuccuuaugcaccgccgcauucacauucaccaaaauccccgcagaaaccuuacacggaaccgugaccgucgaaguacaauacgcaggaaccgauggacccugcaaagucccagcacagauggccguagauaugcaaacccugacaccggucggccgacuaauaacagcaaaccccguaaucacugaaucaaccgaaaacucaaaaaugaugcuagaacuugacccacccuucggcgacagcuacaucguaaucggcguaggcgagaaaaaaauuacacaccacuggcaccgauccggaagcacgaucggcaaggcauucgaagcgacgguccgaggagccaaacgaauggcaguccucggcgacacagcgugggacuucggcagcgucggcggcgcucucaacagccuaggcaaaggcauccaccagaucuucggcgccgccuucaaaucccuauucggcggcaugucaugguucagccaaauccuaauaggcacacuccucauguggcucggccucaacacaaaaaacggcucaauaagccuaaugugccucgcccucggcggcguucucauuuuccucagcaccgcagucagcgcggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7225 - RNA, 2482 nt, Artificial Sequence
  ZIKV prME variant mRNA Design 2 opt
ggggcgcugccuacggagguggcagccaucuccuucucggcaucaagcuuaccaugcggaaagaaaagaaacgccgaggcgcagacacgagcguaggaauagucggccuacuccugacgacagcaauggcagcagaaguaacacgccguggaagcgcguacuacauguaccucgaccggaacgacgcaggagaagccaucagcuucccaaccacccucggaaugaacaaaugcuacauacaaauaauggaccuaggacacaugugcgacgccaccauguccuacgagugccccaugcuagacgaaggaguagaaccagacgacguagacugcuggugcaacacaacauccacguggguaguauacggaacaugccaccacaagaaaggcgaagcacgccggagccgacgagccgucacgcugccaucccacagcacacgaaaacuacaaacccggucccagaccuggcuagaaucaagagaauacacaaaacaccucauacggguagagaacuggauauucagaaaccccggguucgcacucgcagccgccgcaauagccuggcuccugggcucaagcaccucccaaaaagugauauaccuagucaugauacugcugaucgccccggccuacuccaucagaugcaucggggucagcaacagagacuucgucgaagguaugucuggaggaaccuggguagacauaguacuagaacacggaggaugcgucacggucauggcucaggacaaacccaccguagauauagaacuggucaccacaacgguaagcaauauggccgaaguaagauccuacugcuacgaggccagcauaucagacauggcauccgacucacgcugcccaacccaaggagaagcauaccucgacaaacaaagcgauacgcaauacgugugcaaaagaacccuaguagaccgaggauggggaaacggcugcggccuguucggcaaagggucacugguaaccugugcgaaauucgcgugcucaaagaaaaugacagggaaauccauccaacccgaaaaccucgaguaccgaauaaugcuaagcguccacgggucacaacacuccggaaugaucgucaacgacacaggacacgaaacagacgaaaacagagcaaaaguagaaaucacaccgaacagcccccgugcugaggcaacacucgggggauucgggucccuaggacucgacugcgaaccacgaacgggacuagacuucagcgaccuauacuaucucacgaugaacaacaaacacuggcuagugcacaaagaaugguuccacgacaucccccuacccuggcacgcaggagccgacacuggcacaccccacuggaacaacaaagaagcacugguagaguucaaagacgcacacgccaagagacagaccguagucguacucggaagccaagagggggcggugcacacagcacucgcaggagcgcucgaagcagagauggacggggccaaaggccgacuauccagcggacaccucaaaugccgacuaaaaauggacaaacucagacuaaaaggagucuccuacagccuaugcacagcagccuucaccuucaccaagauacccgcagaaacacuccacggcaccgucaccgucgaaguacaauacgccgggaccgauggaccaugcaaagucccagcgcaaauggcaguggacaugcaaacccuaaccccagucggacgucugaucaccgcaaaucccgucaucacagaauccaccgaaaauagcaaaaugaugcuggaacuggacccacccuucggcgacaguuacauagucaucggagucggagaaaagaaaauaacacaccauuggcacagguccgggagcaccauaggcaaagcauucgaagcaacaguacgaggagccaaaagaauggccgucuugggagacacugcaugggacuucggcuccguaggaggagcacucaacagccucggaaaaggaauccaccagauauucggcgcagcauucaaaucccucuucggaggcaugagcugguucucccaaauacuuauaggcacgcuccuaauguggcuaggccucaauaccaaaaacggaagcaucucucuaaugugccucgcgcuaggaggcguccuaauauuccuaucaacagcaguuucagcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7226 - RNA, 2479 nt, Artificial Sequence
  ZIKV prME variant mRNA Design 2 opt
ggggcgcugccuacggagguggcagccaucuccuucucggcaucaagcuuaccaugaaagaaaagaaacgccgaggggcggacacaagcguggguaucgucggccuacucuuaaccaccgcgauggccgcggaggucacccgacgaggcuccgcguacuacauguacuuagaccgaaaugacgccggcgaagccauaucauuccccaccacgcucggcaugaacaaaugcuacauccaaauaauggaccucggccacaugugcgacgccaccaugaguuaugaaugccccaugcucgacgaagggguagagccagacgacguagacuguuggugcaacacaaccagcacaugggucguguacggaaccugccaccacaagaaaggcgaagcccggcgcagccgccgggcagucacacuccccagccauagcacccgcaaacuacagacccgcucgcaaaccuggcucgaaucaagagaauacaccaaacaccucauccgcgucgaaaacuggauauuucgaaaccccggauucgcccuggcagcagcagcaauagccuggcuucucggcuccagcacaagccagaaagucaucuaccucguaaugauccuauuaauagccccagcuuacuccauccgguguauaggggucuccaacagagacuucgucgaaggcauguccgguggaaccuggguagacaucguacucgaacacggaggaugcgucaccgucauggcccaagacaaacccaccguggacaucgaacucgucacaaccacagucucgaacauggccgaagucagguccuacugcuacgaagcgucaauaucagacauggcauccgacagccgaugcccaacccagggagaagcauaccuugacaaacaaucggacacccaauacgucugcaagcgcacacucguggacagaggauggggcaacggaugcggacuauuuggcaaagggagccuaguaaccugcgccaaauucgcgugcagcaagaaaaugacuggcaaaaguauccaaccagagaacuuagaauaucgaaucaugcucagcguccacggaagccaacacuccggcaugaucgucaacgacacaggccacgagacagacgaaaaccgugccaaaguagaaauaacaccaaauagcccccgagcagaggcaacccucggaggcuucgggagccuaggacucgacugcgagccgaggacgggacuagauuucagcgaccuauacuaccuaacaaugaacaacaaacauuggcuuguccacaaagaaugguuccacgacaucccacuccccuggcacgccggagccgacacuggcacaccucacuggaacaacaaagaagcacucguagaguucaaggacgcccacgcuaaacgccaaacaguuguaguacucggcagccaagaaggagccguccacacagcacucgcaggcgcccucgaagccgaaauggauggagccaagggccgacuaucgucaggacaccucaagugccggcucaagauggacaaacucagacugaaaggaguaagcuacagccuaugcaccgccgccuucaccuucaccaagauccccgcagaaacacuccacggaacagucaccgucgaaguacaguacgccggaaccgacggccccugcaaaguccccgcacaaauggccguggacaugcagacccuaacaccaguaggacgccucauaacagcaaauccaguaauaaccgagucaaccgaaaacagcaaaaugaugcuagaacuagauccacccuucggcgacuccuacauaguaaucggcguaggcgagaagaaaauaacacaucacuggcacagaucagguuccacaaucgggaaagcauucgaagccacaguccgcggagccaaaagaauggcgguacuaggcgacacagccugggacuucggaaguguagguggcgcgcucaacucccuagggaagggaauacaccaaaucuucggcgccgcauucaaaagccuauucggcggaaugagcugguucagccaaauucucauaggcacccuccuaauguggcuuggacucaauacaaagaacgggagcauaucccuaaugugccucgcccuaggcggcguccuaauauuucugagcacagcagucagcgcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7227 - RNA, 2476 nt, Artificial Sequence
  ZIKV prME variant mRNA Design 2 opt
ggggcgcugccuacggagguggcagccaucuccuucucggcaucaagcuuaccauggaaaagaagaggcgaggagccgacaccagcguagggauaguaggccuacuccucacaacagcuauggcagcagaagucacacgacgcggcagugcauacuacauguaccucgaccgaaacgaugccggcgaggccaucagcuuccccaccacacuaggcaugaacaaaugcuacauacaaaucauggaccucggacacaugugcgacgcaacaauguccuacgaaugcccaaugcucgacgaggggguagaacccgacgacguagacugcuggugcaacacgaccuccacaugggugguuuacggcacaugccaccacaagaaaggcgaagcccgacgaagccgacgugcagugacacucccaucgcacuccacacgaaaacuacaaacacgaucucaaacauggcuagaaucccgcgaauacacaaaacaccuaauacggguggaaaacuggauauucagaaaccccggcuucgcccuagcagcagccgcaauagcauggcucuuagggagcuccaccucacaaaaagucaucuaccucguaaugaucuuacuaauagcgccggccuacagcauacgcugcauagggguaagcaaccgagacuucgucgaaggaaugagcggaggcaccuggguagauaucguacuagagcacggcggcugcgucacuguaauggcacaagacaaaccuacaguagacaucgaauugguaacaacaacagucagcaacauggccgaagucagaucauacugcuacgaagcgagcauaagcgacauggcaucugacagccgcugccccacccagggcgaagccuaccucgacaaacagucagacacccaauacguaugcaaaagaacacucguagaccgaggauggggcaauggaugcggacucuucgggaaaggaagccuagucacaugcgccaaauuugcaugcucaaagaaaaugacaggaaaaucgauccaaccagaaaacuuagaauaucgaaucaugcugagcguacacggcagccaacacagcggcaugauagucaacgacacuggacacgaaaccgacgaaaaccgggcaaaagucgaaaucaccccaaacucaccaagggccgaagcaacacucggcggcuuuggaagccuaggccucgacugcgaaccccgcaccggacuagacuucucagaccuauacuaccuaaccaugaacaacaaacacuggcuaguucacaaggaaugguuccacgacauaccccucccauggcacgccggcgcagacacaggaacgccccacuggaacaacaaagaagcacucguagaguucaaggacgcccacgccaagcggcagacaguagucgugcucggaucacaagaaggagccguccacacagcccucgccggagcccuugaagcggaaauggacggcgcaaaaggacggcugucuaguggacaccuaaaaugucggcugaaaauggacaaacugcgucuaaaagguguaagcuacagccuaugcacagcagcguucaccuucaccaaaaucccggcagaaacgcuccacggaaccgucacaguagaaguacaauacgcagggacagacggcccaugcaaaguacccgcccaaauggccguagacaugcaaacacuaacaccagucggaagacucauaacagccaaccccguaaucacagaaagcaccgagaacuccaaaaugaugcuggaacucgauccucccuucggcgacagcuauauagucauaggugucggugagaagaaaauaacacaccacuggcaccgcagcggcagcacaaucggaaaagccuucgaagcaaccguucggggagcgaaacgaauggccgucuuaggcgacacagcaugggacuucggcucuguaggcggagcacugaacagccuaggcaaaggaauccaccagauauucggcgcagccuucaaaucacucuucggcgggaugucuugguucucacaaauacucauaggaacacuccucauguggcuaggcuuaaacaccaaaaacggaucgaucucgcugaugugccuagcacucggcggagugcugauauuccuaucgaccgcaguaucggccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7228 - RNA, 2473 nt, Artificial Sequence
  ZIKV prME variant mRNA Design 2 opt
ggggcgcugccuacggagguggcagccaucuccuucucggcaucaagcuuaccaugaagaaacgccgcggcgccgacaccagcguaggaaucgucggacuacuguugacaaccgcaauggccgcggaagugacacgaaggggaagcgccuacuacauguaccucgacagaaacgacgccggagaagccauauccuucccgaccacacuaggcaugaacaaaugcuacauacaaauaauggacuuaggccauaugugcgacgcaacgaugucauacgaaugcccuaugcuagacgaaggaguggaacccgacgacgucgacugcuggugcaacacgacaucgaccuggguagucuacggcacuugccaccacaagaaaggagaagcacgacgaagccgacgggcagucacgcuacccagccacuccacccgaaaacuccaaacucgcagccaaaccuggcucgaaagccgcgaauacaccaagcaccuaauacgagucgaaaacuggauauuccggaacccaggcuucgcccucgcagcagcagcaauagccuggcuccuuggaagcuccacaucccaaaaaguaauauaccuagucaugauacuccuaaucgcccccgcauacagcauccgauguaucggaguauccaaccgcgacuucgucgagggcaugagcggcggcaccuggguagacauaguccucgaacacggaggcugcgucacaguaauggcccaagacaaacccacaguagacaucgagcuggucaccacaacgguaagcaacauggccgaaguccgauccuacugcuacgaagcaagcauaucagacauggcaucagacagcagaugccccacacaaggcgaagccuaccuagacaaacaaagcgacacacaauacguaugcaaacggacguuggucgaccggggcuggggcaacggaugcggucucuucggaaaaggcagccucguaaccugcgccaaauucgcgugcucaaagaaaaugacgggcaaaucaauccaaccggaaaaucuagaguaccggauaaugcuaagcguccacggaucacagcacuccggcaugaucgucaacgacaccggacacgaaacagacgaaaaccgugcaaaaguggagaucacaccaaacagcccccgcgccgaagccacacuaggcggauucggaucccugggacuagacugcgaaccaaggacaggacuagacuucuccgaccucuacuaccucacaaugaauaacaaacacuggcuaguacacaaagaaugguuccacgacaucccacuccccuggcacgccggagcagacacaggcacaccacacuggaacaacaaagaagcacucgucgaguucaaagacgcacaugccaaacgccaaaccgucguagugcuaggaucccaagaaggagcaguccacaccgcgcucgccggagcccuggaagccgaaauggacggagcaaaagggcgccugaguuccggccaccuaaagugccgccuaaagauggacaaacuaagacucaaaggcgucuccuacagccucugcaccgcagcguucaccuucacuaaaaucccggccgaaacacugcacggaacaguaaccguggaggugcaguacgcaggcacagacggacccugcaaagugccggcccaaauggcagucgauaugcaaacacuaacgcccguaggacgacucaucacagccaaccccguaaucacagaguccacagaaaacucaaaaaugaugcuagaacuagaucccccauucggagacagcuacauagucaucggcgucggugaaaagaaaauaacacaccauuggcacagaagcggcucaaccaucggaaaagccuucgaagccacgguccgaggggcaaaacgcauggccguccuaggggacacggcaugggacuucgggagcguagggggagcccucaacucccugggcaagggaauacaccaaauauucggcgccgcuuucaaaagccucuucggcgggaugagcugguucagccaaauccucaucggaacacuucucauguggcucggucuaaacaccaaaaacggaagcauaucgcugaugugccucgcgcuuggcggcguccuuauauuccuaucaaccgccguuuccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7229 - RNA, 2470 nt, Artificial Sequence
  ZIKV prME variant mRNA Design 2 opt
ggggcgcugccuacggagguggcagccaucuccuucucggcaucaagcuuaccaugaagcgccgcggagccgacacaagcguaggaauugucggccuccuucuuacaacagcgauggcggccgaaguaacccgaagaggcuccgccuacuauauguaccucgacaggaacgacgccggcgaagcaaucucauuccccacaacccugggaaugaacaaaugcuacauccagauuauggaccuaggccacaugugcgaugccaccaugucguacgaaugccccaugcuagacgaaggaguagaaccagacgacguagacugcuggugcaacacaaccagcacaugggucguauacggaacaugccaccacaaaaagggcgaagcgcgaagaagccgccgcgcagugacccucccaagccacagcacacgaaaacuccaaacacgcagccaaacauggcucgaaagccgggaauacaccaaacaccucaucagggucgaaaacuggaucuuccgaaaccccggcuucgcacucgcugcagcagcaauagccuggcuucucggauccagcaccucccaaaaagucauauaccuagucaugauacuccuaauagcccccgcauacucuauacgcugcauaggagugaguaaccgagacuucguggaagggauguccggcggaacaugggucgacaucguccuagaacacgguggcugcguaacaguaauggcacaagacaaacccacaguggacaucgagcuuguaacaaccacaguauccaacauggcagaagucagauccuacugcuacgaagccuccauaucugacauggccucagacucacgaugcccaacccaaggagaagcauaccuagacaaacaaagcgacacacaauauguaugcaaaagaacauuagucgaccgcggauggggaaacggaugcggacuuuucggaaaagguucccuagugacuugcgccaaauucgccuguucgaagaaaaugaccggcaaguccauccaaccggaaaaccuggaauaccgaaucaugcuaucuguccacggcucgcaacacucaggcaugaucguaaacgacacgggccacgaaacagacgaaaacagagccaaagucgagauaacccccaacuccccucgcgccgaagccacgcucggcggauucggaagccugggccucgacugugaaccgcgaacaggacuagacuucagcgaccucuacuaccuaaccaugaacaacaagcacuggcuaguccacaaagaaugguuccacgacaucccacucccauggcacgcaggagccgacaccggaacaccacacuggaacaacaaggaagcccucgucgaguucaaagacgcgcacgccaaacgccaaacaguggucguccuaggaucccaagaaggcgccguccacaccgcacuagcgggagcccucgaagccgaaauggacggcgcaaaaggaagacucagcucgggccaccuaaaaugcagacuaaaaauggauaagcuccgacugaaaggaguaucuuacucccuaugcacagcagcauucaccuuuacuaaaauccccgcagaaacacugcacggaacaguaaccgucgagguacaauacgcaggcaccgacggacccugcaaaguaccggcccaaauggccgucgacaugcaaacccucacaccagucggaagacucaucacggcaaaccccguaaucaccgaauccaccgaaaacucuaaaaugaugcuggagcuagacccacccuucggcgacagcuacaucgucaucggagugggagagaagaagaucacccaccacuggcaccgaagcggcagcaccaucggcaaagcauucgaggcgacuguccgcggagcgaaaagaauggccguucucggggacaccgcaugggacuucggguccgucggcggcgccuuaaacagucucggaaaaggcauacaccaaauauucggcgccgcguucaaaagccuguucggaggcauguccugguucucgcaaauacuaaucggcacccuccuuauguggcucgggcuaaacaccaaaaacggaagcauaagccuaaugugccuagcccuaggcggcgugcucaucuuccuuagcacagccguaagcgcggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7230 - RNA, 2467 nt, Artificial Sequence
  ZIKV prME variant mRNA Design 2 opt
ggggcgcugccuacggagguggcagccaucuccuucucggcaucaagcuuaccaugagacggggcgcagacacaagcgucggaaucgucggacuccuacuuacgaccgcaauggcggcugaagucacacgccgaggauccgcauacuacauguaccucgaccguaacgacgcaggcgaagccauaucauucccuacaacgcugggaaugaacaaaugcuacauccagauaauggaccuaggccacaugugcgacgcaaccauguccuacgaaugcccaaugcucgacgaaggggucgaacccgacgacguagacugcuggugcaacacaacgagcacauggguaguguacggaacaugccaccacaaaaagggggaagcccgacgauccaggagagcagugacacucccaagccacagcacaagaaaacuacagacaagaucacaaaccuggcuugaaagcagagaauacacaaagcaccuaauacgaguugaaaacuggauauucagaaaccccggcuucgcacucgcagcagccgccauagccuggcuccugggcaguucaacgagccaaaaagucauauaccuaguaaugauacugcuaaucgccccagcauacucaauacgcugcaucggcguauccaaccgagacuucguagaaggaaugucaggaggaaccuggguagacauuguacucgaacacggaggaugcguaacagucauggcccaggacaaacccacggucgacaucgaacucguaacaacaaccguaucaaacauggcagaaguacgauccuacugcuacgaagcaagcaucucugacauggccucagacucacgaugccccacccagggcgaagccuaccuagacaaacagucggacacacaauacgucugcaaacgaacacuggucgaccgcgguuggggcaacggcugcggccuguucggaaaagggagccuagugaccugcgccaaauucgccugcagcaagaaaaugaccggcaaaucgauacaacccgaaaaccuugaguacagaaucaugcuauccguccacggcagccaacauuccggcaugauagucaacgacaccggccacgaaacagacgaaaacagagcaaaagucgaaaucacgcccaacuccccacgggcggaagccacacugggaggauucggcagccucggccuagauugcgaaccacgcacaggguuagacuucuccgaccucuacuaccuuacaaugaacaacaaacauuggcucgugcacaaagaaugguuccaugacaucccacuccccuggcaugcaggcgccgacacggggacaccacacuggaauaacaaggaggcgcuuguggaguucaaggaugcgcacgccaaacgacaaacaguaguuguccuaggcucacaagaaggcgcgguccacacagcccucgccggggcacuagaagccgaaauggacggcgccaaagggcgacucagcagcggccaccucaaaugccgacuaaaaauggacaaacugcgccuaaaaggggucagcuacagccucugcaccgccgcauucaccuucacaaaaauaccagccgaaacccuacacggcacagucacaguagaaguacaauacgccggcacagacggacccugcaaagucccagcccaaauggcggucgacaugcaaacccucacgccaguaggccgacuaaucacagcaaacccagucaucaccgagagcacagaaaacagcaaaaugaugcuagaacuggacccgccauuuggagauaguuacaucguaauuggcgugggggaaaagaaaauaacacaccacuggcacagaagcggcuccacaaucggaaaagcauucgaagcuaccguccgaggagcgaaacgaauggccguacucggcgacacagccugggacuucggcucaguaggcggagcccugaacucccucggcaaaggaauacaccaaaucuucggggccgcguucaaaucccuguucggaggaaugagcugguucucacagauacucauaggcacacuacuaauguggcuaggccuaaacacaaagaacggcagcauuagcuugaugugccuagccuugggaggcguacuaauauuccuaagcacagccguaucagccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7231 - RNA, 2464 nt, Artificial Sequence
  ZIKV prME variant mRNA Design 2 opt
ggggcgcugccuacggagguggcagccaucuccuucucggcaucaagcuuaccaugcgaggagccgauacuucggucggcauagucggccuacuccuaaccacggccauggcugcagaagucacaagacggggcucagccuacuacauguaccucgacagaaacgaugcaggagaagcaaucucguuccccacaacacugggcaugaacaaaugcuauauacaaaucauggaucuuggccacaugugcgacgcaaccaugagcuacgagugcccaaugcucgacgaaggcgucgaacccgaugacguggacugcuggugcaacacaaccagcacaugggucguauacggaaccugccaccacaagaaaggcgaagcccgccgaucacggcgcgcagugacccuccccucacacuccacccgaaaacuacaaacaagaagccaaaccuggcucgaaucacgcgaguacaccaaacaccuaaucagaguagaaaacuggauauuccgcaacccaggcuucgcacuggccgccgcggcaauagcauggcuccuuggcucaagcacaucacaaaaaguaauuuaccucguaaugauacuacucaucgcccccgccuauagcauccgcugcaucggcgucucaaaucgcgacuucguagaaggcaugagcggcggaacauggguagacaucguccucgaacacggagguugcgucacggucauggcccaagacaaacccacaguagacaucgagcuagucaccacgacagucucuaacauggcugaaguacgaagcuauugcuacgaagcgaguaucuccgacauggcaucagacucacguugccccacccaaggagaggccuaccucgacaaacaauccgacacacaauacgucugcaaacgcacccucguagacagaggaugggggaacggcugcggacuguucggcaaaggaagccucguaacaugcgcaaaauucgcaugcucaaagaaaaugaccggaaaaucaauacaaccagaaaaccucgaauaccgcauaaugcuauccguacacggcucccaacacuccggaaugauaguaaacgacaccggccacgaaaccgacgagaaccgagcaaaagucgagaucaccccuaacuccccacgcgcagaagcaacccuaggcggcuucggcucccucggacuggacugcgaacccagaaccggacuggacuucucagaccucuacuaccucacaaugaacaacaaacacuggcucguucacaaggagugguuccacgacaucccccuccccuggcacgcaggcgcggacacagguacgccacacuggaacaauaaggaggcacucgucgaguucaaagacgcacacgcaaaacgccaaacugucgucguacugggcucccaagaaggagccguacacacagcccucgccggggcacucgaagccgaaauggacggcgccaagggacgacuaagcuccggccaccucaaaugccgacuaaaaauggacaagcuacggcucaaaggcgucucguacagccucugcacagcggccuucaccuucaccaaaauccccgccgaaacucuacacggcacagucaccguagaaguccaguacgcaggaaccgacggccccugcaaggugccagcacaaauggccguagauaugcaaacccuuacccccguaggccgccucauuaccgccaaccccgugauaaccgagagcaccgaaaacagcaaaaugaugcuagaacucgaucccccauucggcgacaguuacaucgucaucggcgucggagagaagaaaaucacacaccacuggcacagauccgguucaacaauaggaaaagccuucgaagcaaccguccgcggagccaaacgcauggcaguacucggcgacaccgcaugggacuucggauccgucggaggagcccuaaacucccucggcaagggaauacaccaaaucuucggcgccgccuucaaaagccucuucgguggaaugucaugguucagccaaauccugaucgggacacuucuaauguggcuuggccuaaacaccaaaaacggcagcaucagucucaugugucuagcccucggcggaguacucauauuccuaucaacagcaguauccgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7232 - RNA, 2461 nt, Artificial Sequence
  ZIKV prME variant mRNA Design 2 opt
ggggcgcugccuacggagguggcagccaucuccuucucggcaucaagcuuaccaugggggcggauaccuccguaggaauagucggacuacuacucacuaccgcaauggccgcagagguaacacgacgcggcagcgccuacuacauguaccuagaccgaaacgacgcaggagaagcaaucagcuuccccacgacacugggaaugaacaagugcuacauacagaucauggaccucggccacaugugcgacgcaaccaugagcuacgaaugcccaaugcuagacgaaggaguagaacccgacgacguagacuguugguguaacaccacaagcaccugggucgucuacggaacaugccaccacaagaagggagaggcccgccgcagcagacgagccguaacacuacccucgcacagcaccagaaaacuacagaccagaagccaaacauggcuagaaagcagagaauacacaaaacaccuaauccggguagaaaacuggauauuuaggaacccgggauucgcacuagcagccgcagcaauagcauggcuacuagggagcucaaccucccaaaaaguaauauaccuagucaugauccuacucaucgcgccagcauacuccauccggugcauaggaguaucaaacagagauuucguagaaggcaugucagggggcaccuggguagacauaguccucgaacacggagggugcguaacggugauggcacaagauaaaccaaccguagacaucgagcuaguaacaacaacagucagcaacauggccgaaguaaggucguacugcuacgaagccaguaucucagacauggccagcgacucacgaugcccaacccaaggagaagccuaccuagacaaacaguccgacacacaguacguaugcaaacgcacgcucgucgaccgaggcuggggaaacggcugcggccuguucggaaaagggagccuggucacaugcgcaaaauucgccugcuccaagaaaaugaccggaaaauccauacaacccgaaaaccuagaauaccggaucaugcucaguguccacggcagucagcauagcggcaugaucguaaacgacaccggacacgaaacagaugaaaaccgagcaaaagucgaaauaaccccaaacucgccccgagcagaagccacauuaggcggcuucggaucccuaggacuagacugcgaaccccgaaccggacucgacuucucagaccuguauuaucucacgaugaacaacaaacacuggcugguacacaaggaaugguuccacgacauaccacuaccauggcacgcuggagcugacaccggaacaccacacuggaacaacaaagaggcccuaguagaguucaaagaugcacaugccaaacgccaaaccgugguaguccuagggucccaagaaggagccgugcacaccgcacucgccggcgcacuggaagcagaaauggacggagccaaagggcgacuaagcuccggccaccuaaaaugcagacucaaaauggacaaauuacgacuuaaaggcguaagcuauucacugugcacggcggcauucacauucaccaaaauacccgccgaaacccuacacggaacagucaccguagaaguccaauacgccgggacagacggaccgugcaaagucccagcccaaauggccguagacaugcaaacacucacccccguaggaagacucauaaccgcaaacccggucaucaccgaaucaaccgaaaacagcaaaaugaugcucgaacuagacccgcccuucggggacagcuauauagugauaggcguaggagaaaagaaaauaacgcaccacuggcaccgaagcggcagcacaauagggaaagccuucgaagccacaguacgaggagcgaaaagaauggcaguccugggagacaccgcgugggacuucggaucgguaggaggcgcacuaaacagccugggaaaaggaauacaccaaaucuucggcgccgccuucaaaucacucuucggcggaaugucaugguucucccagauacuaaucgggacccuccugauguggcuaggucuaaacaccaaaaauggcucaaucucacuaaugugccuagcgcuaggaggcguccucaucuuccuguccacagccguaucggccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7233 - RNA, 2458 nt, Artificial Sequence
  ZIKV prME variant mRNA Design 2 opt
ggggcgcugccuacggagguggcagccaucuccuucucggcaucaagcuuaccauggcagacaccaguguaggcaucguaggacuccuacuaaccacagcaauggccgcugaagucacacgacgcggaagcgcauacuacauguaccuagaccguaacgacgccggcgaagcaaucucguuccccacgacccucggaaugaacaaaugcuacauucaaauuauggaccuagggcacaugugcgacgcgacaaugagcuacgaaugccccaugcucgacgaaggcguggaaccagacgacgucgacugcuggugcaacacaacaagcacauggguggucuauggaaccugccaucacaagaaaggcgaagcacgaagaagccgccgggcaguaacacuuccgagucacagcacccgaaaacuccaaacacgcagccaaacauggcuagaaagccgcgaauauacgaaacaccuaaucagaguagaaaacuggauauuccgaaacccuggcuuugcacucgccgcagcagccauagcauggcuccugggcagcagcacaagccaaaaagucaucuaccuagucaugauacuccuuaucgcccccgcauacucaauccgcugcaucggcgucucgaacagggacuucguggagggcaugagugggggaaccuggguagacaucguccuagaacacggcggcugcgucacgguaauggcacaggacaaaccaacaguagauauagagcuaguaaccacuacaguauccaacauggcagaaguccgcagcuacugcuacgaagcaucgauaucggacauggccagcgauuccagaugcccaacccaaggggaggccuaccucgacaaacaaagcgacacccaguacguaugcaaaagaacacucguggacagaggguggggcaacggcugcggacuauucggcaagggaucacugguaaccugcgccaaauucgccugcuccaagaaaaugaccggcaaaagcauacagccagaaaaccuagaauacagaaucaugcucuccguacacggcucgcaacacagcggaaugaucguaaacgacacaggacacgaaacagacgaaaaccgcgcaaaagucgaaaucaccccgaacuccccgcgcgcagaagcaacacuaggcggcuucggaagccucggacuagacugcgaaccucgaaccggccucgacuucagugaccucuacuaccucacaaugaacaacaaacacuggcuaguacacaaagaaugguuccacgacaucccccuacccuggcacgcgggcgcagacacaggcacaccacacuggaacaacaaagaagcccugguggaguucaaggacgcccacgcaaaacgacaaaccgucgucguacuugggagucaagaaggcgcaguacacacagcacucgccggagcacucgaagccgaaauggacggugccaaaggacgccugagcagcggccaccucaagugcagacuaaagauggacaaacuaagacucaaaggagugagcuacagccuuugcaccgcagccuucaccuucacaaaaauaccggccgaaacccugcacggaacggucaccguagaaguccaguacgccggaacugacggacccugcaaggucccagcacaaauggcgguagacaugcaaacccuaacaccaguagggagauuaauaaccgccaaccccguaaucacagaaagcacggaaaacagcaagaugaugcuagaacucgacccgcccuucggggacagcuacauaguaauaggagucggagaaaagaagaucacccaccacuggcaccgaagcgggagcaccaucgguaaagcguucgaagcaacaguacgcggcgccaaacgcauggccguacucggugacaccgccugggacuucggcucggucggcggggcccucaauagccuuggcaaaggcauucaccaaaucuucggcgccgcauucaaaagccuauucggcggaaugagcugguucagccagauacucauagguacacuucuaauguggcucgggcucaacaccaaaaacggcucaaucagccuaaugugccuggcccucggaggagugcuaaucuuccuaagcacagccgucagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7234 - RNA, 2455 nt, Artificial Sequence
  ZIKV prME variant mRNA Design 2 opt
ggggcgcugccuacggagguggcagccaucuccuucucggcaucaagcuuaccauggacacaagcgucggcaucguaggacuacuacucacaacagccauggcagcugaagucaccagacgcggcuccgcauacuacauguacuuagaccgcaacgacgccggcgaagccaucucauucccaacaacacugggaaugaacaaaugcuacauccaaaucauggaccucggacacaugugcgacgcaacgaugucauaugagugcccuaugcuggacgaaggagucgaaccagacgacguagacugcuggugcaacaccacgagcacgugggucguauacggcacuugccaccacaagaaaggggaagcccgccgcucacgccgagccguaacccuaccaucccacucaacccggaaacuacaaacacgcucccaaacauggcuagaaagcagagaguacacaaaacaccugauacgcgucgaaaacuggauauuccgaaaccccggauucgcccucgccgcugccgccauagccuggcuccugggcagcuccaccucacagaaagucaucuaucucguaaugauccuacucaucgcccccgcauacagcauacgaugcauaggcgucucaaaccgcgacuucgucgaaggaauguccggaggcaccuggguugauaucguccuagaacacgguggaugcguaaccgucauggcacaagauaaacccaccgucgacaucgaacucguaacaaccacagucucgaacauggccgaaguacgauccuacugcuacgaagccagcaucucggacauggccuccgacagccgcugccccacccaaggcgaagcauaccucgacaaacaaagcgacacucaauacguaugcaagcggacacuuguagaccgaggcugggggaacggcugcggacucuucggcaaaggcagccuuguaacgugcgcaaaguucgccugcucaaagaaaaugaccggaaaauccauacaacccgaaaaccuugaauaccgaauaaugcuaagcguccacggaucgcaacauuccggaaugaucgucaacgauaccggccacgaaaccgacgaaaaccgagcaaaagucgaaaucacacccaacagcccccgcgcagaagccacccuagggggcuucggaagccucggacuagacugcgaaccgcgcacaggccucgacuucagcgaccuguacuaccucaccaugaacaauaaacacuggcuaguccauaaagagugguuccacgauauccccuuaccauggcacgcaggagcagacaccggcaccccacacuggaacaacaaagaggcacucgucgaguucaaagacgcacacgccaaacgccaaaccgucgucguacucggcucacaagaaggcgccguccauacagcccuggcgggagcccuagaagcagaaauggacggagccaaaggcagacuaagcucgggccaccucaaaugccgccuaaaaauggacaaacucagacucaaaggaguaagcuacucuuuaugcaccgccgcguucacauucacaaaaauucccgcagaaacccuccacggaacaguaaccguagaaguacaauacgccggcaccgacggccccugcaaagucccggcccagauggccguugacaugcaaacccuaacacccgucggcagacuaauaaccgccaacccaguaaucaccgaauccacggaaaacucaaaaaugauguuagagcuagauccaccguucggagacagcuacaucgugaucggcgucggcgaaaagaaaauaacccaccacuggcaccgcagcggaagcaccauaggcaaagccuucgaagccaccguccgaggggcgaaacgcauggcgguccuaggagacacagcuugggacuucggcagcguaggcggagcgcuaaacucacucggcaaaggcauccaccaaaucuucggcgcggcauucaaaucguuguucggaggaaugucaugguucucacagauacucaucggcacacuccugauguggcuaggccucaacaccaaaaauggcucaauaagccuaaugugccuagcacucggcggcguccuaaucuuccugagcacagccgucagcgcugacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7235 - RNA, 2452 nt, Artificial Sequence
  ZIKV prME variant mRNA Design 2 opt
ggggcgcugccuacggagguggcagccaucuccuucucggcaucaagcuuaccaugacaagcguaggaauugucggacuccuacuaacaaccgcgauggcagcagaaguaacgcgacgcggcucagccuacuacauguaccuagaccgaaacgacgccggagaagccaucucauucccgaccacacucgggaugaauaaauguuacauacaaauuauggaccuaggccacaugugcgacgcaaccaugucguacgaaugcccgaugcucgacgagggagucgaaccggacgacguagacugcuggugcaacaccacguccacaugggucgucuacgggaccugccaccacaagaaaggagaagcacgacgaagccgacgggcgguuacccuaccaagccacagcacacgcaaacuccaaacacgcagucaaaccuggcucgaaucccgagaauacaccaaacaccuaauacgcgucgagaacuggaucuucaggaauccaggauucgcccucgcagcagcagccaucgcauggcuccugggcucgagcacuagccaaaaaguaauauacuuaguaaugauccuacugaucgcccccgcauacucaauacgaugcaucggcguaagcaaccgcgacuucgucgaaggcaugucaggaggaacauggguagacauaguccucgaacacgggggcugcgucacgguaauggcacaggacaaaccaacagucgacauagagcuagugaccaccacagucaguaacauggcggaaguccgaucguacugcuacgaagccagcauaucagacauggccucagacucacgcugccccacacagggagaggccuaccucgacaagcaaagcgacacacaauaugucugcaaaagaacauuagucgaucgcggguggggcaacgggugcggccucuucggcaaaggcagucucguaacaugcgcaaaauuugcaugcuccaagaaaaugacaggaaaauccauacaacccgaaaaucucgaguacagaaucaugcuauccguccacggcucccaacauagcgggaugauagugaacgacacgggccacgaaacagacgaaaaccgagccaaagucgaaauaacacccaacaguccccgcgcagaagcaacacuaggcggguucggcagccuaggcuuagacugcgaaccacgcacaggcuuagacuucagcgaccuauacuaccucaccaugaacaacaaacacuggcugguccacaaagagugguuccacgacaucccacuccccuggcaugcaggagcugacacgggcaccccacacuggaacaacaaagaggcucucguagaguucaaagacgcacacgcaaaacgacaaacagucgugguccuaggcucacaagaaggagcgguacauaccgcacuagccggagcccucgaggccgaaauggacggagcgaaggggcgccuaagcucaggacaccuaaagugccgacuuaaaauggacaaacuacgauugaaaggagucuccuacucccucugcacagcagccuuuacauuuaccaaaauaccggccgagacccugcacgggacuguaacaguugagguacaauacgccgggaccgacggcccaugcaaaguaccagcccaaauggcaguagacaugcagacccuaacccccguagggcgccugauaaccgccaauccagucaucacagaaucaacggaaaacucaaaaaugaugcuagaacuagaucccccauucggcgacagcuacauagucauaggagucggagaaaagaaaauaacccaccacuggcacaggucaggcucaacaaucggaaaagcauucgaagccacgguacgaggcgcgaaaagaauggcgguccucggcgacacugcaugggacuucggauccguaggcggcgcccucaacucacucggaaaaggaauccaccaaaucuucggcgccgcauucaaaucacuguucggcgggauguccugguucagccaaauacucaucggaacgcuacuaauguggcuaggccuaaacaccaagaacgggagcaucucccugaugugccucgcccuaggaggaguacugauauuccugagcacagccguaagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7236 - RNA, 2452 nt, Artificial Sequence
  ZIKV prME variant mRNA Design 2 opt
ggggcgcugccuacggagguggcagccaucuccuucucggcaucaagcuuaccaugaccuccgucggcaucguaggacuccuccuaacaaccgccauggcagccgcaguuacacgacgaggaagcgccuacuacauguaccuagacagaaacgacgccggagaagccauauccuucccgacgaccuuaggcaugaacaaaugcuacauacaaauaauggaccuaggacacaugugcgacgcaacgaugucauaugaaugccccaugcucgacgaaggaguggaaccugacgacguagacugcuggugcaacacgacaucaaccuggguaguauacggaaccugccaccacaagaaaggcgaagcccgacguucccggcgagccguaacccuccccagccacuccacacgcaaacuacagacacgaucacaaaccuggcuagagucacgagaauacacaaaacaccugauacgcguagagaacuggaucuuccgcaaccccggauucgcacuagccgccgcugccaucgcauggcuacuaggcagcucgaccucacaaaaaguaauauaccucguaaugauccuccuaaucgccccagccuacuccauacgcugcaucggggucucaaaccgcgacuuugucgaaggcauguccggaggaaccugggucgacauaguacucgaacacggcggcuguguaaccguaauggcacaagacaagccuacaguagacaucgagcuagucacaacaacaguaucaaacauggccgaaguacgcuccuacugcuacgaagcaagcauaagcgacauggcaagcgacagccggugccccacacaaggcgaagccuaucuugacaaacagagcgacacacaauacgucugcaaaaggacccucguagacagaggcuggggcaacggcugcggacuauucggaaaagggucacucgucacaugcgcaaaauucgccugcaguaagaagaugaccgggaaaagcauccaacccgaaaaccuagaauaccguaucaugcucagcguacacggcucacaacacuccggcaugauugucaaugacaccggucacgaaacagacgagaaccgcgcaaaaguggaaauaacccccaacucgcccagggccgaagcgacacucggaggauucggaucccuuggccuagacugcgaacccaggacaggacucgacuucucagaccucuacuaccuuaccaugaacaacaaacacuggcucguacacaaagaaugguuucacgacaucccccuaccauggcacgcgggagccgacacaggcacaccacacuggaacaacaaagaagcccuagucgaauuuaaggacgcacacgcaaaaagacaaaccguaguuguccuaggaucacaagaaggcgcaguacacacggcccucgccggagcccucgaagccgaaauggacggcgccaaaggccgacuaagcagcggccaccucaaaugccgccugaaaauggacaaacuccgacuaaaaggugucaguuauucccuaugcacagccgccuuuaccuucacaaaaauacccgcagaaacccuccacggcaccgucaccgucgagguccaauacgccggcacggacggccccugcaagguacccgcacaaauggccguggacaugcaaacccugacccccgugggcagacucauaacagcaaacccagucauaacagaaagcacagaaaacuccaaaaugaugcucgaacuagacccgcccuucggggacucauacauaguaauaggcguaggagagaagaaaaucacccaccacuggcaccgaucgggaucuaccaucggcaaagcauucgaagccaccgugcgaggcgccaaacgaauggcaguccucggcgacaccgcaugggacuuuggcucugucggaggagcccuaaacagccucggcaaaggcauccaccaaaucuucggugcagcguucaaaagccucuucggcggcauguccugguucagccaaauccugaucgggacccuacucauguggcuaggccucaauaccaaaaacggauccaucagccuaaugugccuggcccuaggcggaguccugaucuuccucucaacagcagucagcgcagacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7237 - RNA, 2464 nt, Artificial Sequence
  ZIKV prME variant mRNA Design 2 opt
ggggcgcugccuacggagguggcagccaucuccuucucggcaucaagcuuaccaugcgaggcgcggacacgucagucggcauagucggucuacuacuuacaaccgccauggcagccgccguuacacgccggggauccgccuacuacauguaccucgaccgcaacgacgccggcgaagcaaucucguucccaaccacacuaggcaugaacaaaugcuacauccaaauuauggaccuaggacacaugugcgacgccaccaugagcuacgagugcccaaugcuagacgaaggaguggagccagacgacguggacugcuggugcaacacuacaucgaccugggucgucuacgggaccugccaccacaagaaaggagaagcacgaaggucaagacgagcuguaacacuaccaagccacuccacaaggaaauuacagacccgaagccaaacauggcucgaauccagggaauacaccaaacaucucauucgcguagaaaacuggauauuccgcaacccaggcuucgcacuagcggcggccgcgauagcuuggcuccucgggagcuccaccucgcaaaaaguaaucuaccuagucaugauccuacucauagcucccgcguacagcaucagaugcaucggcguaagcaaccgcgacuucgucgaaggcaugagcggcggcaccuggguagacauaguacucgaacacgggggcugugucaccguaauggcacaagacaaaccaacgguggauaucgagcuagucacaacgaccgucuccaacauggccgaaguaagaagcuauugcuacgaggcauccauaagcgacauggcaagcgacucgcgcugcccaacgcaaggugaagcauaccuagacaaacaaagcgacacacaauacguaugcaaacgcacccucgucgacagaggguggggcaauggaugcggacucuucggcaaaggcucccucgucacaugcgcaaaauucgccugcuccaaaaagaugacaggcaaaucaauccaacccgaaaaccuagaguaccgaauaaugcucagcguccacggaagccaacacagcggaaugauagucaacgacacaggacacgaaaccgacgaaaaccgcgcaaaagucgaaaucacaccaaacaguccaagagcggaagcaacacuaggcggauucggaucacuaggacuagauugcgagccacgcacaggacuagacuucagcgaccuauacuaccugacgaugaacaacaaacacuggcucguacacaaagagugguuccacgacaucccccucccauggcacgccggcgccgacaccggcaccccgcauuggaacaacaaagaagcccuaguagaguucaaagacgcacacgcaaagcgccaaaccgucgucguacuaggaagccaagaaggagcgguccacacagcccuagccggcgcccuagaagcugaaauggacggagcaaaaggaagacuaagcagcggucaccucaaaugcagacucaaaauggacaaacuacgccucaaaggcguaucguacucccucugcaccgccgccuucacauucaccaaaauaccagcagagacacuacacggaaccgugacaguggaaguccaauacgccggcaccgauggaccaugcaaaguacccgcacaaauggcaguagacaugcaaacccugacacccgucggcagacuaaucacagccaacccagucauaaccgaaagcaccgagaacagcaagaugaugcucgagcucgacccgccauucggggacagcuacaucgucauaggagugggagaaaagaaaaucacccaccacuggcaccgaagcggcucaacaauaggaaaagcguucgaagcgaccguccgaggagccaaacgcauggcaguacucggugacacagccugggacuucggcucaguaggcggcgcccuaaacucucuaggaaaaggcauacaccaaaucuuuggcgcagccuucaaaucacucuucggcggcaugagcugguucucccagauccuaauaggcacacuacuaauguggcucggacucaacaccaaaaauggcucgaucagccugaugugccucgcacuaggcggcguacugaucuuccuauccacagcgguaagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7238 - RNA, 2488 nt, Artificial Sequence
  ZIKV prME variant mRNA Design 2 opt
ggggcgcugccuacggagguggcagccaucuccuucucggcaucaagcuuaccaugcgcggccuaucgucacggaaaagacggagccacgacgugcuaacagugcaauuccucauacucggcaugcuacuaaugaccggaggcgucacccgccgaggcucagccuacuacauguaccuagacaggaacgacgccggggaagccauaaguuuccccacgacacugggcaugaacaaaugcuauauacaaaucauggaucuaggccacaugugcgacgccaccaugagcuacgaaugcccgaugcuagacgaaggagucgagccagacgacguggacuguuggugcaacacaacauccacauggguagucuacggaacaugccaccauaagaaaggagaagcccgacgcucaaggagagccgugacccucccaagccacucgaccagaaaacuccaaacaagaagccaaacguggcucgaaucgagggaauacacgaagcaccuaauaagagucgaaaacuggauauuccgaaacccaggauucgcacuggccgcggccgccaucgccuggcuacucggaagcagcacgagccaaaaaguaauuuaucuuguaaugaucuugcugauagccccggccuacagcauccgaugcaucggcguuucgaauagagacuucguagaaggcaugagcggcgguaccuggguagauaucguccucgaacacgggggaugcgugaccguaauggcccaggacaaaccgaccgucgacauagagcuaguaaccacaacagucagcaacauggcagaagucaggaguuacugcuaugaagcaucaauaucagacauggcaagcgacagcagaugcccuacacaaggggaggcauaccucgacaaacaaagugacacccaauacgucuguaaaagaacccuagucgaccgcggaugggggaauggcugcggacuauucggaaaagggagccuagugacaugcgccaaauucgcaugcucaaagaaaaugacaggaaaaagcauccaaccagaaaaccucgaguacagaauaaugcucagcguccacgggucacagcacagcggcaugauaguaaacgacaccggacacgaaaccgacgaaaaccgagccaaaguagaaauaaccccuaauagccccagagcugaggcaacccuaggaggcuucggcagcuugggacucgacugcgaaccccgaacgggacucgacuucuccgaccuauacuaccucaccaugaacaacaaacacuggcucgugcacaaagaaugguuccacgacaucccccugcccuggcacgccggcgccgacacaggaacgccucacuggaacaacaaggaagcccuuguagaguucaaagacgcgcacgcaaaacgccaaacgguggucgugcucggaagucaagaaggagccgugcacacggcacuagccggcgcgcucgaagccgaaauggacggagcaaaggggcgacugagcagcggacaccugaaaugccggcugaaaauggacaaacugagacuaaaaggagucagcuacagccuaugcaccgccgcauucacauucacaaaaauaccggccgaaacacuacacgguacagucacgguagaaguccaauacgcggggacagacggacccugcaaagucccagcgcaaauggcgguagauaugcagacacucacacccguggguagauuaauaacagcaaaccccgucaucacagaaagcacggaaaacagcaaaaugaugcuagaacuagacccacccuucggagauucauacauagucauaggcguaggcgaaaagaaaauaacccaccacuggcaccgcagcggcagcacaaucggaaaagcauucgaagcaacggugaggggagccaaacgaauggcgguccucggagauacagccugggacuucggaagugucgggggugcacugaacagccuaggcaaaggcauacaccaaaucuucggagcagcguucaaaagccucuucgggggaaugagcugguucucccaaauauugauaggaacucuacucauguggcucgggcuaaacacuaaaaauggcagcaucagccucaugugccuggcccucggaggcguccucauauuccuaagcacagccgucagcgccgacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7239 - RNA, 2488 nt, Artificial Sequence
  ZIKV prME variant mRNA Design 2 opt
ggggcgcugccuacggagguggcagccaucuccuucucggcaucaagcuuaccaugcgaggccuuagcucccgcaaacgacgcagccacgacguacuaaccguccaauuccuaauacuaggcaugcuccucaugacaggcgccguaacaagacgggguuccgcauacuacauguaccucgacaggaacgacgcgggagaagccauuuccuucccaaccacacucggcaugaacaaaugcuacauacaaauaauggaucucggacacaugugcgacgccaccaugucauacgaaugcccaaugcuagacgaaggaguggaacccgacgacguagacugcuggugcaacaccacauccaccuggguagucuacggaacgugccaccacaagaaaggagaagcacggcgaagccgacgagccguaacccuccccucccacagcacucgcaaacuccaaacacgaucacaaacauggcuagaaucccgcgaauacaccaaacaccuaauacgcgucgaaaacuggaucuuucgaaacccaggcuucgcccucgcagcagccgcgauagcauggcuucuuggaagcagcacaagucaaaaaguaaucuacuuaguaaugauccugcuuauagcgccugcauauucgauacggugcaucgggguaagcaaccgcgacuucgucgaaggaaugucaggaggcaccuggguagacauuguacucgaacacggaggaugcguaaccguaauggcccaagacaaaccuacagucgacauagagcucguaacgaccacaguaagcaacauggcagagguccgaucauacugcuacgaagccucaauaagugacauggccucagacucacgcugcccaacccaaggcgaggccuaccuagacaagcaauccgacacacaguacgucugcaaacgcacacucgucgacagaggguggggcaacgguugcggccuuuucggcaaaggaucacucguaacaugcgcaaaauucgccugcuccaagaaaaugacuggaaaaagcauacaaccagaaaaccuagaguacagaauaaugcuauccguacacgggagccagcacucaggaaugaucgucaacgacacgggacacgaaaccgacgaaaaccgcgcaaaaguagaaauaacacccaacucaccccgagcagaagcgacccuaggaggauucggaucccucggacuagacugugaacccagaacaggccucgacuucagcgaccucuacuaccucaccaugaacaacaaacacuggcuuguccacaaagagugguuccacgacaucccccuacccuggcacgccggagcagacaccggcaccccacacuggaacaacaaagaagcccucgucgaguucaaagacgcgcacgcaaaacgacaaaccgucgucguucuuggaucccaggaaggagccguccauacagcacuagcaggcgcccuggaagccgaaauggacggcgccaaggggcggcuaucaucaggccaccuaaaaugucgccuaaagauggacaaacuccgacuaaaaggggucucauacucucuaugcaccgcggcauucaccuucaccaagauccccgcagaaacccuacacggaaccgucacaguagaaguacaauacgccggcacagacggccccugcaaggucccagcccaaauggccguagacaugcaaacacugaccccaguaggacgacuaauaaccgcgaaccccguaauaaccgaaucgaccgaaaacucaaaaaugaugcucgaacuagacccaccguuuggcgacagcuacaucgucaucggcgucggagagaaaaagauaacccaccacuggcacagguccggaagcaccaucgguaaggcuuucgaagcaaccguccgcggagccaaacgcauggccguccuaggagacacagcaugggauuucggcagcgucggcggagcccugaacagccucggaaaaggaauacaccaaauauucggagccgcguucaaaagccuauucgggggcauguccugguucucacaaauccuaaucggcacacuacugauguggcucggccucaacaccaaaaacgggagcauuagccucaugugucuagcucuaggcggcguacuaaucuuccuauccacagcagugagcgcggacugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7240 - RNA, 2494 nt, Artificial Sequence
  ZIKV prME variant mRNA Design 2 opt
ggggcgcugccuacggagguggcagccaucuccuucucggcaucaagcuuaccaugcgcaucauaaacgccagaaaagaaaagaaacgaaggggagccgacacaucaguaggcaucgucggacuacucuugaccaccgcaauggccgcggaagucaccagaaggggcucagcauacuacauguaccuagaccguaacgacgccggagaagcaaucuccuuccccaccacccuuggaaugaacaaaugcuacauacaaauaauggaucuaggccauaugugcgacgccaccauguccuacgaaugccccaugcucgacgaaggaguagagcccgacgacguggacuguugguguaauaccaccagcacaugggucgucuaugggaccugccaccacaagaaaggcgaagcacgaagaagucgacgagcaguaacacuaccgagccacagcacccgaaaacuacaaacaagaagucaaacauggcuagaaagccgagaauacacgaaacaccuaauaagaguagagaacuggauauucagaaacccaggguucgcccucgccgccgcggccaucgcauggcugcuaggcuccagcacaucgcaaaaaguaauauaccuagucaugauucuacuaaucgcacccgcauacagcauccgcugcauaggcgucucgaaccgcgacuucgucgagggcaugucaggaggcacauggguggacaucgucuuagaacacgguggaugcgucaccgucauggcccaagacaaacccaccguagacaucgagcugguaaccaccaccguauccaacauggccgaagugcgguccuacugcuacgaagccucaauaagcgacauggccuccgacagcagaugcccaacccaaggggaggcguaucucgacaaacaaagcgacacccaauacgucugcaaacgaacacucguagaccgcggguggggaaacggcugcggacucuucggaaaaggcagccucguaaccugugccaaauucgcaugcucgaagaaaaugaccggaaaauccauacaaccagagaacuuagaauaccgcaucaugcuaagcguacauggcagccaacacagcggcaugauaguaaacgacacaggccaugaaacagacgaaaaccgagcaaaagucgaaaucacccccaacagcccgagagcagaagccacacuaggaggauucggcagccuaggccuggacugcgaaccaaggacaggccucgacuucagcgaccucuacuaccucaccaugaacaacaagcacuggcuaguacacaaagaaugguuccacgacauaccacuccccuggcacgcaggcgccgacacagggacaccccauuggaauaacaaagaagcacugguagaguucaaagacgcccacgccaagagacaaaccguaguaguacuaggcucccaggaaggggcaguccacacagcacuagcgggagcacuggaagcagaaauggacggcgccaaagggcgacuaagcagcggccaccugaaaugcagacuuaaaauggauaaacuacgacuaaagggcgucagcuacagccucugcaccgcugccuucacauucacgaaaauccccgccgaaaccuuacacggcacggucacagucgaaguacaauacgccggaaccgacgguccaugcaaaguacccgcacaaauggccgucgacaugcagacacuaacacccgucggacggcuaauaacagccaaccccguuaucacagaaucgaccgaaaauucaaaaaugaugcucgaacuagacccaccguuuggagacuccuacaucguaaucggcgucggagaaaagaaaaucacacaccacuggcaccgcagcggcuccacgauagggaaagcauucgaggccaccguccgaggagcaaaaagaauggccguccucggcgacacagcaugggacuucggcagcgucggaggcgcgcucaacagucucggaaaaggcauccaccaaauauucggcgcagcauucaaaagccuuuucggcggcaugagcugguuuucacaaauccuaauaggaacccuccucauguggcucggccuaaacaccaaaaacgggucaauaagccuaaugugccuggcccucggcgggguccuaauauuccucuccacggcagucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7241 - RNA, 2488 nt, Artificial Sequence
  ZIKV prME variant mRNA Design 2 opt
ggggcgcugccuacggagguggcagccaucuccuucucggcaucaagcuuaccaugauaaacgcccgaaaagagaaaaagcgccgaggagccgacacauccguagguauagucggccucuuauuaacaacagcaauggcugccgaaguaacaagacgcggcagcgcauauuacauguaccuugaccgaaacgaugcaggggaagcaauaucauuuccaacaacacuuggcaugaacaaaugcuauauccaaaucauggacuugggacacaugugcgacgccacaaugucauacgaaugcccgaugcuagacgaagggguggaaccggacgacguugacugcuggugcaacacaacuucaaccuggguagucuacggaaccugccaccacaagaaaggcgaagcaagaagauccagacgggccgucacacuccccagccacagcacuagaaaacuacaaacccgaagccaaacauggcucgaaagccgcgaauacacaaagcaucugauccgaguggaaaacuggaucuuccgaaaccccggcuucgcccucgccgccgcagccauagcauggcuccugggauccuccacgucacaaaaagugauauaccuaguaaugauccugcucauagccccggccuacuccauacgcugcauaggcguaagcaaccgagacuucguagagggaaugucagggggcaccugggucgacaucguccuagaacacgggggcugcgucacagucauggcgcaagacaagcccacagucgacaucgagcucgucacaacaaccguaucaaacauggcagagguaagguccuacugcuacgaagcgucaaucucagacauggccagcgacucccguugccccacacaaggcgaggccuaccuagacaaacaauccgacacacaauacguaugcaaacgaacacucguagaccggggcuggggaaacggcugcggacucuucggcaaaggcagccucgucacaugcgcgaaauucgccugcucaaagaaaaugaccggaaaaagcauccaacccgagaaccuagaauaccgaauaaugcuaagcguacacgggucccaacacuccggaaugaucgucaacgacaccggacacgaaaccgacgaaaacagagcuaaaguagaaaucacgccaaacucgccacgcgcagaagccacgcucggaggauucggaucacuagggcuagacugcgagccacgcaccgggcuagacuucuccgaccuauacuaccuaaccaugaacaacaaacacuggcuuguucacaaagaaugguuccaugacaucccccuccccuggcacgcaggagccgacacaggaaccccacacuggaacaacaaagaagcccuaguagaguucaaagacgcacaugcaaaacgccagaccgucgucguacuaggaucccaagaaggagcuguccauaccgcacucgccggcgcccucgaagccgaaauggacggagccaaagggcgccuaagcuccggacaccucaaaugccgacuaaaaauggacaaacuaagacugaaaggcgucagcuacagccuaugcacagccgcauucacauucaccaaaauuccagcagaaacgcuccacggaacagucaccguagaaguacaauacgccggcacagacggccccugcaaagugccagcccaaauggcgguagacaugcaaacacucacaccagucggccgccuaauaacggcuaacccaguaaucaccgaaagcaccgaaaauagcaaaaugaugcuugaacucgacccgcccuucggagacagcuacaucgucaucggcgucggggaaaagaaaauaacacaccacuggcaccgaagcggguccacaaucggcaaagccuucgaagcaaccguaaggggcgcaaaacgcauggccguacucggagacacggccugggacuucgguuccgucggaggcgcacuaaacagccugggcaaaggcauccaucaaaucuucggagcagcauucaaaucacuuuuugggggaaugagcugguucucccaaauccugaucggcaccuuacuaauguggcugggccuuaacaccaaaaauggcagcaucucgcucaugugccucgcacucggaggaguccuaaucuuccugagcacagccguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7242 - RNA, 2491 nt, Artificial Sequence
  ZIKV prME variant mRNA Design 2 opt
ggggcgcugccuacggagguggcagccaucuccuucucggcaucaagcuuaccaugauaaucaacgcaagaaaggaaaagaaacgccgcggugccgacacaucaguaggcauagucggccuccuccucacgacagcuauggccgcagaaguaacacgacgcggaagcgcguacuacauguaccucgaccgcaacgacgccggagaagcgaucuccuucccgaccacacucggcaugaacaaaugcuacauccaaaucauggaucucggacacaugugcgacgccaccauguccuacgagugcccaaugcuagacgaaggagucgaacccgacgacguagauugcuggugcaacacgaccuccacaugggucguuuacggaaccugucaccacaagaagggcgaagcccgacgaagccgcagagcagucacccuacccagccacuccacucgcaaacuccagacacgaagccaaacauggcucgagagccgagaguacacaaaacaccucauaaggguagaaaacuggaucuuccgaaauccaggcuucgcccuagccgcagccgccaucgcguggcuucuaggcucaagcacgucacaaaaggucaucuaccucgucaugauccuacuaaucgcuccagccuauucaauccggugcauagguguaagcaaccgagacuucguagaaggcaugucaggaggaacauggguagacaucguccuggaacauggcggaugcguaaccgucauggcccaagacaaacccacaguagacaucgaacucgugaccaccaccguaagcaacauggcagaaguccgaagcuacugcuacgaggcuucaaucagcgacauggcaucagacagcagaugccccacacaaggcgaagccuaccuagacaagcagucagacacccaauauguaugcaaacgcacccuagucgauaggggauggggaaacggaugcggacucuucgguaaaggcagucucgugaccugcgcgaaauucgcgugcuccaagaaaaugacgggcaaaagcauucaacccgaaaaccuagaauacagaaucaugcuaucaguccacggcucccaacacuccggcaugauugucaacgacaccggccacgaaaccgacgaaaaccgagcaaaagucgaaaucacacccaacagcccgcgcgccgaagccacacucggcggcuucggcagccugggccucgacugugaaccccgcacaggacuagacuucagcgaccucuacuaccugacaaugaacaacaaacacuggcucguccacaaagaaugguuccacgacauuccccuccccuggcacgccggcgcagauaccggaaccccacacuggaacaauaaagaagcacucguagaguucaaggacgcgcacgcaaaacggcaaacagucgugguccugggcucgcaagaaggcgcaguccacacagcccucgccggcgcccuagaagccgaaauggacggagcaaaagguagacucagcucaggacaccuaaaaugcagacucaagauggacaaauuacgccucaaaggcguaucuuacucccuaugcaccgccgcauucaccuuuaccaaaaucccggcagaaacgcuccauggaacagucaccgucgagguccaauacgccggaaccgauggaccuugcaaaguccccgcccaaauggcgguugacaugcagacccugacccccgucggccgacucaucaccgccaacccagucaucacugaaagcacagaaaacuccaaaaugaugcucgaacucgacccacccuucggcgacaguuacauugucaucggcgucggggaaaagaagaucacacaccauuggcaccgguccggaagcacgauuggaaaggccuucgaagcaaccgucagaggagccaaaagaauggcgguacucggcgacaccgcaugggacuuuggcuccgucggcggagcacuuaacucacucggaaaaggcauacaccaaauauucggugcugccuucaaaucacucuucggcggcaugagcugguucucacagauacuaaucggaacacuacuaauguggcuaggccucaacaccaaaaacggaagcauaucacuuaugugccuagcccucggcggaguacuaaucuucuuguccacagcagucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7243 - RNA, 2485 nt, Artificial Sequence
  ZIKV prME variant mRNA Design 2 opt
ggggcgcugccuacggagguggcagccaucuccuucucggcaucaagcuuaccaugaacgccagaaaagaaaagaaacgaagaggcgccgacaccagcguuggaaucgucggacuacuacuaaccaccgcgauggcagccgaagucacgagaaggggaagcgccuacuacauguaccuagacagaaacgacgcaggcgaggcaauaaguuuccccacaacgcuaggaaugaauaaauguuacauacaaauaauggaucucggacacaugugcgacgcaacaaugagcuacgaaugcccaaugcuagacgaaggagucgaaccagacgauguggacugcuggugcaacacaacuagcacaugggucgucuacggcacaugccaccacaagaaaggagaagcacgaaggagucgcagagccgucacgcuacccagccacucaacgagaaaacuccagaccaggagccaaacguggcuagagagcagagaauacacaaaacaccuaauaagagucgaaaacuggaucuuccgaaacccaggcuucgcccucgccgccgcagccauagccuggcuccuagguucuaguaccagccaaaaaguaauauaccuagugaugauccuacugauagcacccgcauacuccauccguugcauaggagucagcaaccgcgacuucguagaaggaaugagcggaggaaccugggucgauaucguacuagaacacggcggcugcgucacagucauggcccaagacaaaccaaccgucgacauagaacucgugacaacaacaguuagcaacauggcggaagugcgaagcuacugcuaugaagccuccauaucagacauggcaucggacagccgauguccaacacaaggagaagccuaccuagacaagcaauccgacacacaauacguaugcaaaagaacccuagucgaucgaggcuggggcaacgggugcggccuuuucggaaaaggaagccuggucacaugcgccaaauucgcgugcagcaagaaaaugacaggcaaaucaauccaaccagaaaaccucgaauaucgaaucaugcucucgguacacggcagccaacacuccggaaugaucguaaacgacacaggucacgagacagacgaaaacagagcaaaagucgaaaucacgcccaacagcccaagagccgaagcaacacucggcggguucgggagccuaggacuagacugcgaaccccgaacaggccucgacuucucggaccucuacuaucuuaccaugaacaacaaacacuggcuaguccacaaagaaugguuccacgacaucccccuccccuggcacgcaggggcagacaccggaacgccgcauuggaacaauaaagaggcucuagucgaguucaaggacgcacacgcgaaaagacaaaccgucgucguauuaggcucacaagagggcgccguccacacagcgcucgcaggggcacuagaagccgagauggacggcgcgaaaggaaggcuaucaucaggucaccucaaaugccggcuuaagauggacaaacugagacuaaaagggguauccuauucacucugcacagcagcauucacauucacaaaaauccccgcagaaacacugcacggaacaguaaccguagaaguccaauacgcaggcaccgacggcccaugcaaaguaccugcccaaauggccguagacaugcagacccuaacgcccgucggccggcucaucacggccaacccgguaauaacugaaucaacagaaaacucuaaaaugaugcuggaacuggacccacccuucggcgacaguuacauagucaucggugucggugaaaagaaaaucacccaccacuggcacagaagcggaagcacuauaggcaaagcguucgaagccacaguaagaggcgcaaaaaggauggcaguacuaggagacaccgccugggacuucggcucaguaggaggagcacuaaacucgcucggcaagggaauccaccaaauauucggagccgcauucaagagccuauucggcggaaugagcugguucucacaaauccuaaucggaacgcugcuaauguggcucggccuaaacacaaagaacggcagcaucagccuaaugugccucgcccucgggggcguccuuauauucuugagcacagcaguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7244 - RNA, 2482 nt, Artificial Sequence
  ZIKV prME variant mRNA Design 2 opt
ggggcgcugccuacggagguggcagccaucuccuucucggcaucaagcuuaccauggccaggaaagagaaaaagagaagaggcgcggacacaucaguaggaauagucggacuacugcuaacaaccgccauggcagcagaaguaacccgaagaggcucagccuacuacauguaccucgaccgaaacgacgccggagaagccauaucauuccccaccacccucggaaugaacaaaugcuacauccagaucauggaccucggccacaugugcgaugcaaccaugagcuacgaaugcccaaugcucgacgaaggcguagaaccagacgacguagacugcuggugcaacacaaccaguacguggguagucuauggcacaugccaccacaagaaaggcgaagcacgcagaagccgccgcgcagucacucucccaucucacagcaccagaaaacuccagacaaggagccagaccuggcuggaaucccgagaauacaccaaacaccuaauaagggucgaaaacuggauuuuccgcaacccaggcuucgcacucgcagccgcagccauagccuggcuacugggcagcagcacaagccaaaaagugaucuaucucgucaugauacuccugauugccccagcuuacuccaucagaugcaucggcguaagcaaccgagacuucgucgaggggaugucgggaggaaccuggguugacaucguacucgaacacggcggaugcguaaccguaauggcucaagacaaacccaccguugacauagaacuggugacaaccacaguauccaacauggcagaggugagaucauacugcuacgaggcuucaaucucugacauggccucggacagccgcugccccacacagggggaagcguaccucgacaaacaaucagacacacaguacgucugcaaacgaacccucguagaccgcggauggggcaacgggugcgggcuauucggcaaaggaucacucgucacaugcgcaaaauucgcuugcucgaagaaaaugacaggcaaaagcauacaaccagagaaccucgaauacagaauaaugcugucaguacacggcucacaacacagcggaaugauugucaacgacacaggacacgagaccgacgaaaacagggccaaaguagaaauaacccccaacagcccccgagccgaggcaacacuuggaggauucggcucccuaggauuagacugcgaaccgcgcaccggacuggacuuuagcgaccuauacuaccucacaaugaacaacaaacacuggcuaguccacaaagagugguuccacgacauaccccucccauggcaugccggagcagacacaggaaccccacacuggaacaacaaagaagcgcugguagaguucaaagacgcccacgcaaaacgccaaacagucgugguccucggcagccaagaaggcgccguccacaccgcacucgccggcgcacuagaagcagaaauggacggcgcgaaaggccggcucagcuccgggcaccuaaaauguagacuaaaaauggauaagcuacgccuaaaagggguaucauacagccuaugcaccgccgccuucacauucacaaaaauaccggcagaaacacugcacggaacaguaacagucgaaguacaauacgcaggaaccgauggcccaugcaaaguuccagcccaaauggcagucgacaugcaaacacugaccccggucggaagacuuaucacagcaaaccccgucaucacagaaucaaccgaaaacagcaaaaugaugcucgaacuagacccaccauucggcgacaguuacauagugauaggcguaggagagaagaaaaucacccaucacuggcacagauccgggagcacuauagggaaagccuucgaggccacaguaaggggagccaaacgcauggccguccucggugacacagcaugggacuucggcucaguaggcggcgcccucaacucccucggaaaaggaauccaccaaauauucggggccgcauucaagagccuguucgggggcaugagcugguucucccaaauccuaauaggcacccuccucauguggcuaggccucaauaccaaaaacggaaguaucucacucaugugccuagcacuaggcggcguccucauauuccucagcacagccguuagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7245 - RNA, 2479 nt, Artificial Sequence
  ZIKV prME variant mRNA Design 2 opt
ggggcgcugccuacggagguggcagccaucuccuucucggcaucaagcuuaccaugcgaaaagagaagaaaagacgcggagcagacaccagcgucggaaucgucggccuucuccucacuacagccauggccgccgaagucacgagacgcggauccgcauacuacauguaucuagaccgaaacgacgccggcgaggcaaucucauuccccaccacccucggcaugaauaaaugcuauauccagauaauggaccucggccacaugugcgacgcaacaaugagcuacgaaugccccaugcucgacgagggaguagaacccgaugacguugacugcuggugcaacacaaccucgaccugggucguguacggcacaugccaccacaagaaaggagaagcgagacgcucccgucgagcaguaacccuuccaucccacagcacccggaaacuccaaacacgcucccaaaccuggcucgaaucccgcgaauauacaaaacaucuaauccgaguagaaaacuggaucuuccgcaacccgggauucgcccuggcagcggccgccaucgccuggcuacucgguagcuccaccagccaaaaaguaaucuaccucguuaugauacuacuaaucgccccagcauacucaauacgcugcaucggcguaagcaaccgagacuucgucgaaggaaugucaggcggcaccugggucgacaucguccuagaacacggcggaugcgucaccgucauggcgcaagacaaaccaaccguagacauagagcuaguaacaaccaccguaucaaacauggccgaaguccgaagcuacugcuacgaagcaucgauauccgacauggccuccgacucacgcugccccacccaaggagaagccuaccuagacaaacagucggauacgcaauacgucugcaaacgaacccuagucgaccgaggcuggggaaacggcugcggccucuucggaaaagggucccuaguaaccugcgcaaaauucgcaugcagcaagaaaaugacaggcaaguccauccagcccgaaaaccucgaauaucgaauaaugcucuccguccacggcucacaacacagcggaaugaucgucaacgacaccggacacgaaaccgacgaaaaccgagcaaaagucgagauaaccccaaacucaccucgcgcugaggcaacacucggaggcuucggcucccucggacucgacugcgaaccacgaaccgggcuagacuucagcgaucuauauuaccucaccaugaacaacaaacacuggcuaguccacaaagaaugguuccacgacauaccacuccccuggcacgccggcgcagacaccggcacgccccacuggaacaacaaagaagcccuggucgaguucaaagacgcccacgccaaacgucaaaccgucgugguacucgggucccaagaaggagcaguccacacagcacuugcgggcgcccuggaagccgaaauggacggcgccaaaggacgucucuccagcggacaccuaaagugccgccugaaaauggacaaacuacgacuaaagggagucucauacagcuuaugcaccgccgccuucacauuuaccaaaauacccgcagaaacgcuacacggcaccguaaccgucgaaguacaauacgcgggaacagacggacccugcaaaguaccugcucaaauggccguagacaugcaaacacucacaccagucggaagacuaaucacagcaaaccccguaaucaccgaaagcaccgaaaauuccaaaaugaugcucgaacuagacccaccguuuggagacucuuacaucguaauaggagugggcgaaaagaaaaucacacaucacuggcaccgaucgggaucgaccauagguaaagccuucgaagcaacagugcgaggcgccaaacgaauggcuguacuuggagacaccgcaugggauuuuggcuccguuggaggagcccuuaacagccucggcaaaggcauacaccagauuuucggcgcagccuucaaaucccucuucggcggcauguccugguucucccaaauccucaucggaacccuacucauguggcuaggccucaacacgaaaaacggaucaauaucccucaugugccuagcacugggcgguguacuaauauuccucuccaccgccgucucagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7246 - RNA, 2476 nt, Artificial Sequence
  ZIKV prME variant mRNA Design 2 opt
ggggcgcugccuacggagguggcagccaucuccuucucggcaucaagcuuaccaugaaagagaaaaagaggagaggcgcggacacguccgucgguauaguaggccuacuucuaacaaccgccauggccgcagaaguaacccgucgaggaagcgccuacuacauguaccucgaccgaaacgacgccggcgaagcgaucagcuuccccaccacccucggcaugaacaaauguuacauccagauaauggaccucggccacaugugcgacgccacgaugucauacgaaugccccaugcuugacgaaggcguugaaccagacgacgucgacugcuggugcaacacuacaagcaccuggguggucuacggcacuugccaccacaaaaagggagaagcacgccgcagccgucgagccguaacccuucccucacacagcacccgaaagcuccaaacccgcucccaaaccuggcuagaaucucgagaauacaccaaacaccucauuagagucgaaaacuggauauuccgcaauccaggcuucgcccuagcagcagccgcaaucgccuggcuucucggauccucaacaucacagaaagucauauaccucguuaugauacuccuaaucgccccagccuacagcaucagaugcaucggcgucagcaaccgagacuucguagaaggcaugagcggaggaacauggguagacaucguccucgaacacggaggaugcgucaccguaauggcccaagacaaacccacaguugacauugagcuagucacaaccaccgugagcaacauggccgaagugcgcagcuacugcuacgaagccuccauaucagacauggcaucagacagccgcugcccuacacagggagaagcauaccuggacaaacaguccgacacacaauacgucugcaaacgaacccucguagaccgaggcuggggaaacggaugcggacuauucggcaaaggcucccucgucacaugcgcaaaguucgccugcagcaagaaaaugaccggcaaaucuauccagcccgagaaccucgaauacagaauaaugcucuccguacacggaucccaacacagcggcaugaucgucaacgacacaggacacgaaacugacgaaaaucgcgcgaaagucgaaaucacacccaacuccccucgagcggaagcuacccugggcggcuucggcagccuaggccucgauugcgaaccacgaacaggcuuagacuucuccgaccucuacuaccuaacgaugaacaauaaacacuggcuaguccacaaagaaugguuccacgacauaccguuaccguggcacgccggggccgauaccggaacaccacauuggaacaacaaagaagcacugguagaguucaaagacgcccacgcaaaacgccaaaccgucgucguacucgggucccaagaaggcgcaguccacacagcccucgcaggagcccucgaagccgaaauggacggcgcaaaaggccgccucagcaguggucaccuaaaaugcagacuaaaaauggacaaacuccgacuaaaaggcgucucguacucccuguguaccgcagcuuucacuuucaccaagauccccgcagaaacccuccacggcaccgucaccguagaagugcaauacgcagggaccgauggccccuguaaaguaccggcccaaauggcagucgacaugcagacccugacacccgugggccggcucaucacagcaaaccccguaauaacagaauccaccgaaaacuccaagaugaugcuagagcuagaucccccauucggcgacagcuacauagucaucggaguaggagaaaagaaaaucacacaccacuggcaccgguccggcuccaccauaggcaaagcauuugaagcuacaguccgcggcgccaaacgcauggcaguacuuggcgacaccgccugggacuucggcuccguaggaggggcgcucaacagccuagggaaaggaauccaccaaaucuuuggagccgcauucaaaucccuauucggcggcauguccugguucucucaaauccugaucggcacccuacucauguggcuaggccucaacaccaaaaacggcuccaucucccuaaugugccuggcacucggaggaguacucaucuuccuauccacagccgucuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7247 - RNA, 2473 nt, Artificial Sequence
  ZIKV prME variant mRNA Design 2 opt
ggggcgcugccuacggagguggcagccaucuccuucucggcaucaagcuuaccauggagaagaaaagaagaggagcagacaccagcguaggcaucguaggccuccuacucacaaccgcaauggccgccgaaguaacccgccggggcuccgcauacuacauguaccuagaccgcaaugaugccggcgaagcaauaucguuccccaccacccucggcaugaacaaaugcuacauacaaaucauggaccuaggacacaugugcgacgccaccauguccuacgaaugccccaugcuagacgaagggguugaacccgaugacgucgacugcuggugcaauacaacgagcaccugggugguuuacggaacgugccaccacaagaaaggggaggcccgccgcucccgcagagccguaacccuccccucacacagcaccagaaaacuacagacacgaagccagacauggcucgaaucacgagaauacaccaagcaccucauccgcguagaaaacuggauauuccgcaaccccggcuucgcccuagccgcagccgccaucgccuggcuccuuggcuccucaacaagccaaaaagucauauaccucgucaugauucuacucaucgcgcccgccuacuccauccguugcaucggagucuccaacagagacuucgucgaaggcaugucaggaggcaccuggguugacaucguccuugaacacggggguugcguaacggugauggcccaggacaaacccacaguagacauagaacuugugaccacaacuguauccaacauggcggaaguccgcucauacugcuacgaagccagcaucucggacauggccuccgacucccgaugcccaacacaaggcgaagcauaccucgacaaacaauccgacacccaauacgucugcaaacggacacucgucgaccgcggauggggaaacggcuguggucuauucggcaaaggaucccuagugaccugcgcaaaauuugcuugcucaaagaaaaugacgggaaaaucaauccagcccgaaaaccucgaauacagaaucaugcuuuccguccacggcagccaacacagcggaaugauagucaacgacaccggccaugaaaccgacgaaaaccgggccaaaguagaaaucaccccaaacucaccccgcgcagaagccacccucggaggguucggaagccucggacucgacugcgaaccacgcacuggacuagacuucucagaccuguacuaucucacgaugaacaauaaacauuggcuaguacacaaagagugguuccacgauauaccacuaccauggcacgccggagcagacacaggcacaccccacuggaacaacaaagaagcccucguagaguucaaagacgcacacgccaaacgucaaaccgucguaguacucgguucacaagagggcgcuguacacaccgcacuagccggcgcccucgaagccgaaauggauggagccaaagggcgccuauccucaggccaccuaaaaugccgacucaaaauggacaaacuucgccucaaagggguaucauacucccuaugcacagccgccuucaccuucacaaagauacccgccgaaacauuacacggcaccgucacagucgagguccaauacgccggcaccgacggacccugcaaagucccggcacagauggcaguagacaugcaaacccucacacccgucggccgccuaauaacagcaaaccccgucaucaccgaaucaaccgaaaacagcaaaaugaugcuggaacucgacccacccuucggcgacuccuacaucguaaucggcguaggcgaaaagaaaauaacccaucacuggcacagguccgguagcaccaucggaaaagcauucgaagcaaccguccgaggcgccaaacggauggcuguacuaggagacacugccugggacuucggcuccguuggcggcgcccuaaacucgcuaggcaaaggaauccaccaaaucuucggcgccgccuuuaaaagccuauucggaggaaugagcugguucucacaaauccucaucggaacacuacuaauguggcugggacugaacaccaaaaacggaagcauaucacuuaugugccucgcacuagguggcguucuuaucuuccucagcacagcgguaucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7248 - RNA, 2470 nt, Artificial Sequence
  ZIKV prME variant mRNA Design 2 opt
ggggcgcugccuacggagguggcagccaucuccuucucggcaucaagcuuaccaugaagaaacggcgaggcgccgacacaagcgucggcaucguaggccuacuccuaaccaccgcuauggcagccgaaguaacacgccgaggaagcgcauacuauauguaccuagaucgcaacgacgcaggcgaggccaucagcuuccccaccacauuaggcaugaauaaaugcuacauccaaauaauggaucuaggccacaugugcgaugccacaaugaguuacgaaugcccaaugcucgacgagggagucgaacccgacgacguagacugcuggugcaacaccacuucaacaugggucguauacggaaccugccaccacaagaaaggcgaagcaaggagaucaaggagagcugucacgcuccccucacacagcacccgcaaacuacaaacacggucccaaaccuggcuggaaagccgagaguauacaaaacaccuaauccgcgucgaaaauuggauauucagaaaccccggcuucgcgcucgcagcagccgcaauagcauggcuacucggcucaagcacuucacaaaaagucaucuaucuagucaugauccuucucaucgcaccagcauacaguauacgcugcauagggguaagcaaccgggacuucguugaaggaauguccgggggcacguggguagacauaguacuagaacacggaggaugcguaacgguaauggcccaagacaaacccacaguggacaucgagcuaguaacgacaacagucagcaacauggccgagguacggucauacugcuacgaggcaagcauaucagacauggcauccgacucaaggugccccacacagggcgaggccuaccucgacaagcaaagcgacacacaauacgucugcaaacggacccucguagauagaggcuggggcaacggaugcggccucuucggaaaagggagccuaguaacaugcgcaaaauucgccugcagcaagaaaaugaccggaaaaagcauacaaccagaaaaccuugaauaccgcauaaugcuaagcguacacggcagccaacacagcgguaugaucguaaacgacacaggacacgaaaccgacgaaaauagagcaaaaguagaaauaacaccgaacuccccucgggcagaagccacacucgggggauucggaagccuaggccuagacugcgagcccagaaccggacuggacuucagcgaccucuacuaccuaacaaugaacaacaagcacuggcuaguacacaaagaaugguuccacgacauaccucucccauggcacgcaggggcagacacaggcacaccccacuggaacaauaaagaagcccuaguggaguucaaagacgcccacgcaaaaagacaaaccguaguaguccucggaagccaagaaggcgccguccacaccgcgcuagccggggcgcuggaagcggaaauggacggcgccaaaggacgacuaagcagcggccaccuaaaaugccgacuaaaaauggacaaacuaaggcucaaaggcguauccuacucacucugcacagccgccuucaccuucacaaaaauaccagcagagacgcuccacggcacagugacgguggaaguccaauaugccggcacagacggaccaugcaaggugccagcacaaauggcggucgacaugcaaacacuaacacccguaggccgccuaauaaccgccaaccccguaaucaccgaaagcacggaaaauucgaaaaugaugcuagagcucgacccaccguucggagacucauacaucgucauaggagugggcgagaaaaagauaacacaccacuggcaccgaagcggcuccacaaucggaaaagcauucgaagccacaguaagaggggccaagagaauggccguacucggagauacagcaugggauuucgggucaguaggcggagcccuaaacagccuaggcaaaggcauccaccagaucuucggagcagcauucaaaagucucuuuggaggaauguccugguucucccaaauacugaucggcacacuacugauguggcugggacuaaacaccaaaaacgggagcaucucacucaugugucuggcacugggcggaguacucaucuuccuaagcacagccguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7249 - RNA, 2467 nt, Artificial Sequence
  ZIKV prME variant mRNA Design 2 opt
ggggcgcugccuacggagguggcagccaucuccuucucggcaucaagcuuaccaugaaaagacgcggcgcggacaccuccgucggcauagucggucuucugcucacaacagcaauggccgcagaggucacacgaagaggcagcgccuacuacauguaccucgaccgaaacgacgcaggcgaagcaaucucauuccccacaacccuaggcaugaacaaaugcuacauccagauaauggaccuaggccacaugugcgacgccacaauguccuacgaaugcccuauguuagacgaaggaguugaaccagacgacguagacugcuggugcaacacaacaucaacgugggugguguauggcacaugccaucacaagaaaggagaagccagacgcagcagacgagcagucacccuacccagccacucaacacgaaaacuccaaacacggucacagacauggcucgaaagccgcgaauacacgaaacaccuaauccgggucgagaauuggaucuuccgcaauccaggauucgcccucgcagccgcagccaucgccuggcuacuaggaagcuccaccucacaaaaagucaucuaccucgucaugauacuccuaauagcaccagccuacuccaucagaugcauaggcgucagcaaccgcgacuucguagaaggaaugaguggcggcaccugggucgacaucguccuagaacacggcggaugcguaaccgugauggcgcaggacaaacccaccguggacauagagcuagucaccaccaccgucucgaacauggcagaaguacgauccuacugcuacgaagccagcauaagcgacauggcaagcgacagucgcugccccacccaaggagaagccuaccuagauaaacaaagcgacacccaauacgucuguaaacgaacccuagucgaccgcggauggggcaacggcuguggacucuucgggaaaggcucacuggugacaugcgccaaauucgcgugcucuaagaaaaugacagggaaaucuauccaacccgaaaaccuagaauaccgcaucaugcuaagcguacacggcucacaacacuccggcaugauaguaaacgacacaggacacgaaaccgacgagaacagagccaaaguagaaaucacgcccaacucccccagggccgaagcaacccucggcggcuucggaucccuugggcuagacugcgaacccagaaccggacucgacuucagcgaccucuacuaccuaacaaugaacaacaaacacugguuagugcacaaggaaugguuccacgacaucccacuaccauggcacgcgggagcagacacuggcacaccccacuggaacaacaaagaagcucucgucgaguucaaggacgcccacgccaaaaggcaaacagucgucguccuagggagccaggaaggagccgugcacaccgcacucgcuggcgcccuggaagccgaaauggacggagccaaaggcagacuaucaagcggacacuuaaaaugcagacuaaaaauggauaaacuccgucuaaaaggcguaagcuacagccuaugcaccgccgcguucacauucaccaaaauaccagcagaaacucuccacggcaccgugacaguagaaguccaguacgccggcacggauggaccauguaaaguaccggcccaaauggcaguagacaugcaaacacucacacccguaggacgccuaaucaccgcaaaccccgugauaaccgaaucaaccgaaaacagcaaaaugaugcucgaacucgacccaccauuuggagauagcuacaucgugaucgggguaggagagaaaaagaucacgcaccauuggcaccgcucaggcucaaccauaggaaaggccuucgaagcaaccguacgaggagcaaaacgcauggcaguacuaggagacacugccugggacuucggcucaguaggcggagcacucaacucccuaggcaaaggaauacaccaaaucuucggcgccgccuucaaaagccucuucggcgguauguccugguucagccaaauccugaucggcacacuucuaaugugguuaggacucaacaccaaaaacggcuccaucucccuaaugugccuagcacucggcggcguacucaucuuccuaagcacagcaguguccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7250 - RNA, 2464 nt, Artificial Sequence
  ZIKV prME variant mRNA Design 2 opt
ggggcgcugccuacggagguggcagccaucuccuucucggcaucaagcuuaccaugagacgaggcgccgacacaucaguuggaauaguaggacuacuacuaaccacagccauggccgcagaaguaacaagacgcggauccgccuauuacauguaccuagaccgaaaugacgcaggcgaggcgaucagcuucccaacaacgcugggaaugaacaaaugcuacauacaaauaauggaccuuggccacaugugugacgcaacaaugagcuacgaaugccccaugcucgacgagggcgucgaaccagacgacguagacugcuggugcaauacaacaagcaccuggguagucuacggaacaugccaccacaaaaagggagaagcacgacgcagccgccgagcgguaacccuccccagccauucgacccggaaacuacagacccgaagccaaaccuggcuagaaucacgcgaauacaccaaacacuuaaucagaguggagaacuggaucuuccgcaaccccggauucgcacuagcagcagccgcaauagcauggcuccuaggcagcagcacaagccaaaaggucauauaccucgugaugaucuuacucauagccccagccuacagcauacgaugcauaggcguguccaacagagacuucgucgaaggcaugagcggaggcacauggguagacauaguacucgaacacggcggaugcguaacggugauggcccaagacaaaccaacaguagauaucgaacuggucaccaccacagucagcaauauggcagaaguaagauccuacugcuacgaagcauccauaagcgacauggcaagcgauagcagaugccccacacagggcgaagccuaccucgacaaacaaucagauacacaauacgucugcaagcgcacccuggucgacagaggcuggggaaauggaugcggccuauuuggaaaagggucccuggucacgugcgcaaaguucgcgugcagcaagaaaaugaccggcaaaagcauccaacccgagaaccucgaauacagaauaaugcucagcgugcacgggagccaacacagcggcaugauaguaaacgacacuggacacgaaaccgaugagaaccgagccaaagucgaaauaaccccuaacucaccacgagcagaagcgacacuagggggcuucggcagucucgggcuagacugcgagcccagaaccggccucgacuuuuccgaccucuacuaccuaaccaugaacaacaaacacuggcucgugcacaaagaaugguuccacgacaucccacucccauggcacgcaggagcagacacaggaacaccccacuggaacaacaaagaggcacucgucgaguucaaggacgcccacgcaaaaagacaaacaguaguaguucucggaagccaagaaggagcaguacacaccgcccuugcaggggcccucgaagccgagauggacggagcgaaaggccggcuaucgucaggccaccucaaauguagacuaaagauggacaaacucagacuaaaaggagugucauacagccugugcacagccgcguucacauucacaaaaauaccggcggaaacacuccacgggacggucaccguagaggugcaauacgccggcaccgacggccccugcaaagucccggcacagauggccgucgacaugcaaacccucacaccaguaggccgacuaaucacagccaacccgguaauaacggaauccacagaaaacucaaaaaugaugcuagaacucgacccaccauuuggcgacagcuacauagugauagggguaggcgaaaagaaaaucacacaccacuggcaccgaagcggcagcaccauagggaaagcauucgaagcaaccguacggggagcaaaacgcauggcaguacucggggacacagccugggacuucggcagcguaggcggugcacuaaacucacuaggcaagggcauacaccaaauauucggggcggccuucaaaucucuauucgggggcaugagcugguucucacaaauccuaaucgggacccuccucauguggcuaggacucaauacaaagaacggcagcauaucgcucaugugccuggcauuaggaggaguccuaaucuuccucagcacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7251 - RNA, 2461 nt, Artificial Sequence
  ZIKV prME variant mRNA Design 2 opt
ggggcgcugccuacggagguggcagccaucuccuucucggcaucaagcuuaccaugcgcggagcagacaccagcgucggcaucgugggccuccuucugacaacagccauggccgcggagguaacacgaagaggcagcgcguacuacauguaccuagacagaaaugacgcaggagaagccaucucguucccaacaacccuaggaaugaacaaaugcuacauccaaaucauggaccuaggccacaugugcgacgccaccaugagcuacgaaugcccaaugcucgacgaaggaguagagcccgacgacguagacugcuggugcaacaccaccagcacauggguaguauacggaaccugccaccacaaaaagggggaagcucgccgaagccgccgcgcugucacacuccccagccacagcaccagaaaacuccaaacccgcucacaaaccuggcuagaaagccgagaauacaccaaacacuuaauccgaguggaaaacuggauauucaggaaucccggcuucgcccuugccgccgccgcaauagccuggcuccucggcagcucaaccucacaaaaagucauauaccuagucaugauacuccuaauagcccccgccuacuccauaagaugcauaggcguaagcaacagagacuucguagaagggaugucuggcggcaccuggguagacauuguacucgaacacggcggcugugugacagugauggcccaagacaaaccaaccguagacaucgagcuagucacaaccaccgucuccaacauggccgaagucagauccuacugcuacgaagcgagcauauccgacauggcguccgacagccgaugccccacacagggcgaagccuaccucgacaaacaaagcgacacccaguacguauguaaacgcaccuuaguggacagaggauggggcaacggcugcggacucuucggcaagggaucccucgucacaugcgccaaauucgcaugcucgaagaaaaugaccggcaaaagcauccaaccagaaaaccucgaauaccgaauaaugcucucgguacacggcagccaacacagcggaaugaucguuaacgacaccgggcacgagacagacgaaaaccgugccaaagucgaaauaacccccaacagcccaagagcagaggccacccucggcggauucgguagccuaggacuagacugcgagcccagaaccggccuggacuucucagaccucuacuaccuaacuaugaacaacaaacacuggcuaguccacaaagaaugguuccacgacauaccccuacccuggcacgccggagcagacacaggcaccccacacuggaacaacaaagaagcccuaguagaguucaaggacgcacacgcaaaacgccaaacaguuguaguccuuggcagccaagaaggagccguccacaccgcccucgcaggagcccuagaagcagaaauggauggcgcgaaaggccgccuaucauccggccaccuaaaaugcagacucaagauggacaaacuaagacucaagggagucuccuacucccuauguaccgcagccuucacguucaccaaaaucccagcagaaacacuccacggcaccguaaccgucgaaguacaauaugccgguacagacggacccugcaagguaccagcccaaauggccguggacaugcaaacccuaacacccguaggccgccugaucacagcgaaccccguuaucaccgaauccacagaaaacucaaagaugaugcucgaacuagacccacccuucggagacuccuacauagucaucggcgucggggaaaagaaaauaacacaccacuggcaccgcuccggcagcaccauagguaaagcauucgaggccaccguacgaggagccaaacgaauggccguacuaggcgacaccgccugggacuuuggauccgugggcggcgcacuaaacucacuaggcaaaggaauacaccaaaucuucggggcagccuucaaaagccuauucggcggaaugucuugguucucacaaauccucauaggaacacuccugauguggcucggacugaacaccaaaaacggauccauaagucuaaugugccuagcacugggcggaguccuaaucuuccugagcaccgcaguauccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7252 - RNA, 2458 nt, Artificial Sequence
  ZIKV prME variant mRNA Design 2 opt
ggggcgcugccuacggagguggcagccaucuccuucucggcaucaagcuuaccaugggcgccgacacaucggucggaauagucggacuacuccucacaacagccauggcagcggaagucacgcgaagaggcuccgccuacuacauguaccucgaccgcaacgacgcaggggaagcgaucagcuuccccaccacccucgggaugaacaaaugcuacauacaaauaauggaucuaggacacaugugcgacgcgacgaugagcuacgaaugccccaugcuagacgaaggaguagaaccagacgacgucgacuguuggugcaacacaacauccacuugggugguauauggaaccugccaucacaagaaaggagaagccaggaggucccgcagagccgucacacuccccagccacuccacucgcaagcuacaaacaagaucacaaaccuggcuagaaagcagggaauauacaaaacaccuaauaagaguggaaaacuggaucuucagaaaccccggcuucgcccuagccgcagcggccauagccuggcuacucggcagcuccacaagccagaaagucaucuaccucguaaugauccuucugaucgccccagcguacuccauacgguguauaggaguauccaaccgcgacuucgucgaaggcaugucaggcggaacaugggucgacauaguccucgaacacgguggaugcgucacgguaauggcacaggacaaacccacggucgauaucgagcuaguaacaaccacggucuccaacauggccgaaguccgcucauacugcuacgaagccuccauauccgacauggcguccgacucccgcugcccaacccaaggcgaagccuaccucgacaaacaauccgacacccaauacguaugcaaacgaaccuuagucgaccgcggaugggggaacggauguggccuauucggcaagggcucgcucguuacaugcgccaaauuugccugcucgaagaaaaugacgggaaaaagcauccaacccgaaaaccuagaauacagaauaaugcuaucgguccauggaucacaacacucagggaugauaguaaacgacacgggacacgagaccgacgaaaaccgcgcgaaagucgaaauuaccccaaacaguccucgcgcagaagcaacccuaggcggguucggaagccucggccucgacugcgaaccacggacaggcuuagacuuuagcgaccuguacuaccucaccaugaacaacaaacacugguuaguccacaaagaaugguuccacgacauaccccuaccauggcacgccggagccgauacagguacaccccacuggaacaacaaggaagcgcuaguggaguucaaagacgcccacgcaaaacgccaaaccgucgucgucuuaggcagccaagaaggagccguccacaccgcgcucgccggagcccuagaagcagagauggacggagcaaaaggacgccuaaguucagggcaccuaaagugccgacugaaaauggacaagcugcgucucaaaggcguguccuacucacuaugcacggcggcauuuacguucaccaaaauccccgcagaaacccuacacggaaccgucaccguagaaguccaauaugccggaacggacggacccugcaaggucccagcccaaauggccgucgacaugcagacccugacccccguaggccggcuaauaaccgcaaacccgguaauaacagaaucaacagagaacucaaaaaugaugcucgaacuggacccacccuucggcgacuccuacauagucaucggaguaggagaaaagaaaauaacccaccacuggcaccgcagcggaagcaccauaggcaaagcguucgaggcgaccguccgcggcgccaaaaggauggcaguccuaggagacaccgcaugggacuucggaagcguaggaggcgcccucaacucacuaggaaaaggaauccaccaaaucuucggagcggcguucaaaagccucuucggcggaaugagcugguucucacaaauccucaucggaacccugcuaauguggcucggacuaaacaccaaaaacgggagcaucucccuaaugugucucgcacuagguggcguccucaucuuccucagcacagcaguaucagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7253 - RNA, 2455 nt, Artificial Sequence
  ZIKV prME variant mRNA Design 2 opt
ggggcgcugccuacggagguggcagccaucuccuucucggcaucaagcuuaccauggccgacacaagcguaggaauaguaggacugcuccugaccacagcaauggcagcagaaguaacaagacgaggcuccgcguauuacauguacuuagaccgaaacgacgccggagaagccauaucuuuccccaccacccuagggaugaacaagugcuacauucaaauaauggacuugggccacaugugcgaugcgaccaugagcuacgagugccccaugcuagacgagggcgucgaaccagacgacguagacugcuggugcaacacgaccucaacauggguaguauacgggacaugccaccacaagaaaggagaggcacgaagaagccgacgagccguaacgcuacccucccacucgacacgcaaacuccaaacaagaucccaaacauggcuggaaagcagggaauacacaaaacaccucauuagaguagaaaacuggauauuucgaaacccaggcuucgcccuagcagcagcagcgaucgccuggcuccucggaagcagcaccucgcaaaaaguaauuuaccucguaaugauacuacuaaucgcgccagcauacagcaucagguguaucggaguaagcaacagagacuucguagaaggcaugucaggaggaaccuggguagacaucguacuagaacacggaggaugcguaaccgugauggcucaagacaaaccaaccguagacaucgagcuaguaaccacuacagucuccaauauggcugaagucagauccuacugcuacgaagccucaauuagcgacauggcgagcgacagccgaugcccgacccaaggagaagccuaccucgacaaacaaucggacacccaauacguaugcaaaaggacacuggucgaccgaggcugggggaacggcugcggccuguucgggaaaggcagccucguaacaugcgcgaaauucgccugcuccaagaaaaugacuggaaaaucaauccaaccagaaaaccuggaauacagaaucaugcucuccguacacgggagccaacacagcggaaugaucguaaacgacaccggccacgaaaccgacgaaaaccgcgcgaaagucgaaauaacgcccaacucacccagagccgaggccacacuaggagguuucggaucacuagggcucgacugcgaacccaggaccggacuagacuucagcgaccucuacuaccucacaaugaacaacaaacacuggcuagugcacaaagaaugguuucacgacauaccccuacccuggcacgcaggcgcagacaccggcacgccccacuggaacaacaaagaagcacucgucgaguucaaagacgcccacgccaaacgccagaccguagucguccuaggaagccaagaaggagcaguccacaccgcccuagcaggggcucuagaagccgaaauggacggcgcaaagggacgacucagcagcggccaccuaaaaugccgccugaaaauggacaaacucagacucaaaggaguaucauacucacuaugcacagcagcauucacauucaccaaaauccccgcagaaacccuccauggaacagucacagucgaaguucaauaugccggcacagacggaccaugcaaaguacccgcacaaauggccguagacaugcagacgcuaacccccgucggaaggcucauaacagcuaaccccgucauaaccgaaagcacagaaaacuccaaaaugaugcucgaacucgaucccccguucggcgacucguacauugucauaggcgucggagaaaagaaaaucacacaccacuggcaccgcucaggcagcacaaucggcaaagccuucgaagcgacaguacggggagccaaacgaauggccguccucggagacacagccugggacuucggaagcgucggaggagcccuuaacagucugggaaaaggaauccaccaaaucuucggggcagcuuucaaaagccucuucggcggcaugagcugguucagccaaauccuaaucggaaccuuacuaauguggcucgggcugaacacgaaaaacggguccauaagccucaugugccucgcccugggcggaguccucauauuccuaagcacagccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7254 - RNA, 2452 nt, Artificial Sequence
  ZIKV prME variant mRNA Design 2 opt
ggggcgcugccuacggagguggcagccaucuccuucucggcaucaagcuuaccauggacacaagcgucggaauagugggucuccuacucacgaccgcaauggccgcagagguaacccgaaggggcucugcauacuacauguaccuggaccgcaacgacgcaggcgaagccauaucauuccccacgacacucggaaugaacaaaugcuauauacagaucauggaccucggacauaugugcgacgccaccauguccuacgaaugccccaugcuagacgaaggcguggaaccagacgacgucgacugcugguguaacaccacgagcaccuggguagucuacggcacaugccaccacaagaaaggggaagccagaagaucacgccgagcgguaacgcucccgucacacuccacaagaaaacuacagacacgaagccaaaccuggcucgaaagccgcgaauacaccaagcaccuaauaagaguagagaacuggauuuuccgaaacccuggguucgcgcuagcagcugcagcaauagccuggcuccuagggagcucaacgucacagaaagucaucuaccucgucaugauacuacugaucgcacccgccuacuccauccgaugcauaggcgucucaaaccgcgacuucguagaaggcauguccggagggaccugggucgauaucguucucgaacacggaggaugcguaacagucauggcccaggauaaacccacaguagacauagaacucguaacaacgacagucucaaacauggccgaaguaagguccuacugcuacgaagcaucaaucucggacauggccuccgacucacgaugccccacccaaggcgaagccuaccucgacaaacaaucagacacccaauaugucuguaaacggacccucguagaccgcggcuggggcaacggaugcggccuauucggcaaaggcucccuagugaccugcgccaaauucgcaugcucaaagaaaaugacaggcaaaagcauacaacccgaaaacuuagaauaccguaucaugcuuuccguacacggcagccaacacuccggcaugaucgucaaugacaccggccacgaaacugacgaaaauagagcaaaaguagaaaucacaccaaacagcccacgagcggaagcgacgcucggcggcuuuggcucacucggccucgacugugagccaagaacaggacuagacuucuccgaucuauacuaccucacgaugaacaacaaacauuggcuaguacacaaagaaugguuucaugauaucccccuaccuuggcacgccggagccgacacaggaacaccucacuggaacaauaaagaggcacucguagaguucaaagacgcacacgccaaaagacaaaccguagucguccuuggcucacaagaaggcgccguacacaccgcccucgccggagcacucgaagccgagauggacggcgccaaaggccgacuaucuagcggccaccucaagugcaggcucaagauggauaaacuacgacucaagggaguaucauacucccuaugcaccgcagcauucacguucacaaaaauacccgcagaaacccuacacggcacagucacaguggagguacaguacgccggcacagacggaccauguaaagucccagcacagauggccguugacaugcagacccuaacccccgucgggagacucaucacagcaaacccaguaaucacagaaagcacagaaaacucaaagaugaugcucgaacuugacccacccuucggcgacuccuacaucgucauaggaguaggagagaagaaaauaacccaccacuggcaccgcuccggaaguacaauaggcaaagcauucgaagccaccguccgaggcgcaaaacgcauggcgguccuaggcgacaccgcgugggacuucggaagcgucggcggcgcacucaacucucugggaaaaggcauacaccagauuuucggcgcagccuucaaaucccuauucggcggcaugagcugguucagccaaauacucaucggcacucuccuaauguggcuaggccucaacacgaaaaacggcagcauaagccuaaugugccucgcccuaggaggaguccuaauauuccuaucaacagcagugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7255 - RNA, 2449 nt, Artificial Sequence
  ZIKV (strain ZikaSPH2015) Polyprotein(108-794) mRNA Design 2 opt
ggggcgcugccuacggagguggcagccaucuccuucucggcaucaagcuuaccaugaccagcgucgggaucgucggccuccuacuaaccacagcaauggcagcagaaguaaccaggcgcgguuccgccuacuauauguaccucgacagaaacgacgcgggcgaagccaucuccuuuccaaccacacucggcaugaacaaaugcuacauccaaauaauggaccucggacacaugugcgacgccacgauguccuacgaaugucccaugcuagacgaaggugucgaaccagacgacguagacugcuggugcaacaccaccagcaccugggugguauacggcacaugccaccacaagaaaggcgaagccagacgaucgcgccgagccgucacgcuccccucccacucgaccagaaaacuacaaacccgcucucagaccuggcucgaaucgcgagaauauaccaaacaccuuauacgagucgaaaacuggauauuccgcaacccaggauuugcauuagccgccgcagcaaucgccuggcuacucgggagcucaacaucacaaaaaguaauuuaccucgucaugauccugcucauugccccagcuuacucaauacgauguaucgggguaagcaaccgagacuuugucgaaggcaugagcggagggaccugggucgacaucguccucgaacacggcggcugcguaacagucauggcccaggauaaacccaccgucgacauugagcuagucacaaccacagucucgaacauggccgaaguacgcagcuacugcuacgaagcguccauaagugacauggccagcgacucccgcugccccacucaaggcgaagccuaccucgauaaacaaagcgacacccaauacguaugcaaaagaacccucgucgaccgaggcuggggcaacgguugcggccuauucggaaaaggcucccuaguuaccugcgcaaaguucgcaugcucaaagaaaaugaccggcaaauccauccaaccagaaaaccuggaauaccgcauaaugcugagcguccacggcucccaacacuccggaaugaucgucaacgacacagggcacgaaacggacgaaaaccgcgcaaaaguugaaauaacccccaauagcccccgcgcagaagcaacacucggcggcuucggaagccuagggcucgacugcgaaccccgcacaggccucgacuucuccgaccuguacuaccuaaccaugaacaacaaacacuggcucguccacaaagaaugguuccacgacaucccacuaccauggcacgcgggugcagacacaggcacaccccacuggaauaacaaagaagcccucguagaguucaaagaugcccacgcaaaaagacagaccgucguaguccucggcagucaagaaggcgccguccacacggcucucgccggagcccuagaagccgaaauggacggagcaaaaggaaggcuauccucaggccaccucaaaugcaggcucaagauggacaaacuaagacucaaaggcguaagcuacagccucugcacagccgcauucaccuucacgaaaauucccgcggaaacgcuacacggcacagugacagucgaaguccaguacgcaggcacagacgggccaugcaaaguacccgcacaaauggcggucgacaugcagacacucacccccguaggaagacuuaucacagcaaaccccguaaucacagaauccacagaaaacagcaaaaugaugcuagaacuagauccacccuucggagacuccuacaucguaauaggcgucggagaaaagaaaaucacucaccauuggcacagaagcggcuccacaauagggaaagccuucgaggcgacaguacgcggagcuaaacgcauggccguacucggggacaccgccugggacuucggcuccgucggcggcgcacuaaacagucucggcaaaggaauacaccaaaucuucggcgccgccuucaaaucccuauucggaggcaugagcugguucagccaaauccugauaggcacauugcucaugugguuaggccucaacaccaaaaacggcagcaucagccucaugugccucgcacucgggggaguacuaauauuccuauccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7256 - RNA, 2449 nt, Artificial Sequence
  ZIKV prME variant mRNA Design 2 opt
ggggcgcugccuacggagguggcagccaucuccuucucggcaucaagcuuaccaugaccuccguaggcaucgugggacuccuccucacaaccgcaauggccgcagccguaaccagacgcggcuccgcauauuacauguaccucgacagaaacgacgccggcgaagcgaucucguuucccaccacccucgggaugaacaaauguuacauccaaaucauggaccucggccacaugugcgacgccaccaugagcuacgaaugccccaugcuagaugaaggaguagaaccagacgacguagacugcuggugcaacaccacaucaacauggguaguguacggcacaugucaccacaagaaaggugaagcacggcgcagcagacgcgcgguaacgcuccccucacacuccacacgcaaacuccaaaccagaagccaaaccuggcuagaaagccgagaauacaccaaacaccucauacgagucgaaaacuggauauucagaaaccccggauucgcccucgcggccgcggcaauagcuuggcuacucggauccucgaccucacaaaaagucaucuaccuggucaugaucuuacucauagcaccagcauacucgauccgguguaucggcgugucuaaccgcgacuuugucgagggcauguccggcggcaccuggguggacaucguccuagaacacgggggcugcgucaccguuauggcccaagacaaacccacgguagacauagagcucgucaccaccacaguauccaacauggccgaaguccgaucauacugcuacgaagccuccauaagcgacauggccucagacucccgcugccccacacaaggugaagcauaccuagacaaacaaucagacacgcaauacgugugcaaacgcacucuggucgaccgaggcuggggcaacggcugcggccucuucggcaagggaagccuaguaaccugcgccaaauucgccugcucaaagaaaaugaccggcaaaucaauccaacccgaaaaccucgaauaccgaaucaugcuaucaguccacggaucacagcacucuggcaugauagucaacgacacaggucacgaaacagacgaaaaccgcgccaaaguugaaaucacccccaacucaccucgagcagaagccacccucggaggauucggcucccuaggccuagacugcgaaccacgcacaggacuagacuucagcgaccucuauuaccucaccaugaacaacaaacauuggcuaguucacaaagaaugguuccacgacauaccccucccauggcaugccggugcagacaccggaacaccucacuggaacaacaaggaagcccucguagaguucaaggacgcacacgcaaaacgacaaacagucguaguccucggaagccaggaaggagccguucacaccgcacuugcaggagcccuggaagccgaaauggacggugccaaaggccgccuuuccucagggcaccucaaaugccgccucaaaauggacaaacuacgccucaaaggcgucucuuacucccucuguacugccgccuuuaccuucaccaagauaccagcagaaacucugcacggcaccgucacagucgaaguacaauacgcuggcaccgacggacccugcaaaguccccgcccaaauggccgucgacaugcagacccuaacccccguaggaagacuaaucacagccaauccagucaucaccgaauccacagaaaacucaaaaaugaugcucgaacucgauccacccuucggagacagcuacauugucaucggcgucggugaaaagaaaauaacacaccacuggcaucgaucaggcucaacgaucggaaaagcguucgaagcuacaguacgaggcgccaaacggauggccguccucggcgacaccgcuugggacuucggcuccgucggaggugcacucaacucacucggcaaagguauccaccaaaucuucggcgcagcguucaagagccucuucggcggcaugucaugguuuucacaaauacucauaggaacacuacucauguggcucgggcucaacacaaagaacggcagcauaagccucaugugccucgcacuuggcggcguccuaaucuuccuaucgacagcaguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7257 - RNA, 2461 nt, Artificial Sequence
  ZIKV prME variant mRNA Design 2 opt
ggggcgcugccuacggagguggcagccaucuccuucucggcaucaagcuuaccaugcgcggcgcggacacaucagucggcaucgucgggcuacuacucacgacggccauggcagccgcugucacaagacgaggaagugccuauuacauguaccucgaccgcaacgacgccggggaagccaucuccuuccccacaacacucggcaugaacaaaugcuacauccaaaucauggaccucggccauaugugcgacgccaccaugucauacgagugcccaaugcuagacgaaggagucgagccagacgacgucgacugcugguguaacacaaccuccacauggguaguuuauggcacgugucaccacaaaaagggcgaagcccgccgaagccgcagagccgucacccuaccuucacacagcacccgcaagcuacaaacacgcagccaaaccuggcuggaaucacgagaauacacaaagcaccuaauacgcgucgagaacuggauauuccgcaaccccggcuucgcacuagcggccgcagcgaucgcauggcuccucggcuccagcacaucgcaaaaggucaucuaccucguaaugauacuccuaaucgcacccgcguauagcauacgguguauaggcgucagcaaccgagacuucguagaaggcaugagcggugguacaugggucgacaucguccucgaacacggaggcugcgucacagucauggcacaagacaagccaacaguagacaucgaacuuguaaccaccaccguuagcaacauggcugaaguuagaucauacugcuacgaagccagcauaagcgacauggccucagacagccgaugcccaacgcaaggagaagccuaccuagacaaacaaucggacacccaauacgucugcaaacgaacccuagucgaccgcggcuggggaaauggaugcggccuauucggaaaaggaucccucgucacaugcgccaaauucgcgugcucaaagaaaaugaccggcaaaagcauacaaccagaaaaccuagaauacagaauaaugcucucaguccacggcagccaacacagcggcaugaucgucaacgacacaggccacgaaaccgacgaaaacagagcaaaagucgagauuacaccuaacaguccacgcgcugaagccacccuaggcggauucggaucgcuaggccucgacugcgaaccacguaccggacuagacuucuccgaccuauacuaccucacaaugaacaacaaacacuggcucguacacaaagaaugguuccacgacauaccccuacccuggcacgccggagcagacaccgggacaccacacuggaacaacaaagaagcccucgucgaguucaaagacgcccacgcaaaacgccaaacagucgucguauugggcucccaagaaggggcaguccacacagcccucgcgggagcccuagaagcagaaauggacggcgccaaaggacgacuaagcuccggccaccuuaagugcagacucaaaauggacaaacugcgacuuaaaggagucucauacucacucugcacagcagcuuucacauucacaaaaauaccagcagaaacccuucacggcacagugacgguagaaguccaguacgccggaaccgacggccccugcaaaguacccgcccaaauggccguagacaugcaaacgcuaaccccaguuggacgucucauaacagcuaacccaguaaucaccgaaucgacugaaaacucgaagaugaugcuagaacucgacccaccauucggcgacagcuacaucguaaucggcgucggcgagaaaaagauaacucaucacuggcaccgcagcgguagcacaaucggcaaagccuucgaagccacgguaaggggagcaaaacgcauggcaguccugggggacaccgcaugggauuucggaucggugggcggggcccuaaacucacugggcaaaggaauccaccagaucuucggcgccgcuuucaaaucacucuucggcggcauguccugguucucacaaauacucaucggaacacuacucauguggcucggacucaacaccaaaaacggaagcauaagccucaugugccucgcacuaggaggaguccucauuuuccucucaaccgccguuuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7258 - RNA, 2485 nt, Artificial Sequence
  ZIKV prME variant mRNA Design 2 opt
ggggcgcugccuacggagguggcagccaucuccuucucggcaucaagcuuaccaugcgcggccugagcagcagaaaacgacgaucacacgacguacucacaguccaauuccucauacucggaaugcuacucaugaccggcggggucacgagaagaggcagcgcauacuacauguauuuagaccgaaacgacgccggcgaagccaucuccuuccccaccacacugggcaugaacaaaugcuacauccaaaucauggaccuaggacacaugugcgacgcgaccaugucauacgaaugcccgaugcucgacgaaggcgucgaaccagacgacgucgauugcuggugcaacaccacauccaccuggguaguauacggcacaugccaccacaagaaaggagaagcccgacgcagccggcgcgcugucacccucccgucacacucuacccgaaagcugcaaacccgaucacagaccuggcuggaaucacgcgaauacacaaaacaccucauccgcgucgaaaacuggauauuccgcaaccccggcuucgcccuagcagcugcagccaucgccuggcuacucggcuccagcaccagccaaaaggucaucuaccucguaaugauccuccucauagccccagcauacucaauccgaugcaucggagugagcaaccgugacuucgucgaaggaauguccggcgggacaugggucgauauugugcucgaacacggaggcugcgucacaguaauggcccaagacaaaccaaccguagacauagagcucguuaccaccaccguauccaacauggccgaagugcgcuccuacugcuacgaagcaagcaucagcgacauggccuccgauucaagaugccccacgcaaggcgaagcauaccuagacaaacaaucagacacacaauacgucugcaaacgaacccucgucgacaggggaugggggaacggcugcggccuuuuugggaaaggaucccuagucaccugugccaaauuugcaugcagcaaaaagaugaccggaaaaucaauucaaccagaaaaccucgaauaccgaauaaugcucucaguccacggcagccagcacagcggaaugaucguaaacgauacaggccacgaaacagacgaaaaccgcgccaaaguagaaauaacacccaacucaccccgcgcagaagccacacuagguggauucgggagccuaggacuagacugcgaaccccgcacaggucuagacuucuccgaccucuacuaccucacaaugaacaacaagcacuggcuaguccacaaagaaugguuccacgacaucccgcuaccauggcacgccggcgccgacaccggaacaccccacuggaacaacaaagaagcccuagucgaguucaaagacgcacacgcaaagagacaaacugucguaguccucggcucccaagaaggcgccguccauaccgcacucgcaggcgcauuagaagccgagauggacggcgcaaaaggacgacuaagcagcggacaccucaaaugccgccuaaaaauggacaaacugagacucaaaggagucucuuacucacucugcaccgccgcauucaccuucacgaaaauccccgccgaaacccuccacgguaccguuaccgucgaaguccaauaugcagggacagacggcccaugcaaaguccccgcccaaauggcagucgacaugcagacccucacgccagucggcagacuaaucacagcaaaccccgucauaaccgaaagcacggaaaacuccaaaaugaugcucgaacuagaucccccauucggcgacucauacaucgucaucggaguaggugagaaaaagaucacccaccacuggcacagaagcggaagcacgaucgguaaagccuucgaagccacuguccgaggugccaaacgcauggcugugcucggagacaccgccugggacuucgggagcgugggcggagcccuaaacagccuagggaaaggcauacaccagaucuucggcgcagcauucaagagcuuauucggcgggaugagcugguucucacaaauccucaucggaacacuccucauguggcuaggacucaacaccaaaaacggaagcauaagucugaugugccucgcccucggaggaguccuuauauuccuauccacagccgucagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7259 - RNA, 2485 nt, Artificial Sequence
  ZIKV prME variant mRNA Design 2 opt
ggggcgcugccuacggagguggcagccaucuccuucucggcaucaagcuuaccaugagaggccuaucaagccgcaaaagacggucacacgacguauuaacaguacaauucuuaauccuaggcaugcugcuaaugacaggggcaguuacccgccgaggcucagcguacuacauguaccuggaccguaacgacgccggcgaagcaauuagcuucccaaccacacucgggaugaacaaaugcuacauccaaauaauggaccuaggacacaugugcgacgccacaaugucguacgaauguccaaugcuagacgaaggcgucgagccagacgacgucgacugcuggugcaauacaaccagcacaugggucguauacggaaccugccaccacaagaaaggcgaagcccgccgaucccgccgcgcaguaacccuccccagccacagcacccgaaaacuccaaacccggagccaaacauggcuagagagcagggaguacacaaaacaccugaucaggguagagaacuggauauuccgaaaccccggauucgcacucgccgccgcagcuaucgccuggcuacucggauccuccaccucucaaaaggugaucuaucuuguaaugauccuccucauagcacccgccuacucaauacgcugcauaggaguuagcaacagagacuucgucgaaggcaugagcggcggaacaugggucgacaucguccucgagcacggcggaugcgucacagucauggcccaggacaaaccaaccguagacauagagcuaguaacaacaacaguauccaauauggccgaaguccgcuccuacugcuacgaggcaucaaucucagauauggccucagacucgcgauguccaacccaaggggaagccuaccucgacaagcagagcgacacacaguacguauguaaaagaacccuuguugaccgaggcuggggaaacggaugcggccuauuugguaaaggaucacucguaaccugugccaaauucgcaugcuccaagaaaaugaccggcaaaagcauacaacccgagaaccucgaauaccgcauaaugcucagcguacacggcagccaacacagcgggaugauaguaaacgacaccggacacgaaaccgacgaaaaucgagcgaaaguagaaauaacaccaaacagcccaagagccgaagccacccucggcggauucggaagccucggacuagacugcgagccgcgcacagggcucgacuucuccgaccucuacuaccucacaaugaacaacaaacacuggcucguccacaaagaaugguuccacgacauaccacuccccuggcacgccggcgccgauaccggcaccccacacuggaacaacaaagaggcccuggucgaguucaaagacgcgcacgccaagcgccaaacaguggucguacucggaucacaagaaggcgcaguacacacagcccucgccggagcccucgaagccgaaauggacggcgccaaaggacgccuaagcuccggccaccucaagugccgccucaaaauggacaaauugcgacucaagggagucagcuacucacugugcacagccgccuucacauucacaaaaauccccgccgaaacacugcacggaacagucacaguagaaguacaauacgcaggcacugacggaccauguaaaguaccggcgcaaauggcagucgacaugcaaacccucacgccagucggacgacuaaucaccgccaauccagucaucacagaaagcacagaaaacucaaaaaugaugcuagaacuagaucccccauucggagacagcuacaucgugauaggcgucggcgaaaagaaaaucacccaccacuggcaccgaagcggcucaaccauaggcaaagcguucgaagccaccgucagaggcgcuaaacggauggcaguacucggcgacacggcaugggacuucgguucagucgggggcgcgcuaaacagccucggcaaaggaauccaccaaauuuucggggccgcauucaaaagccucuucggcggaaugaguugguucucccaaauacuaaucggcacccuccugauguggcuaggccuaaacaccaaaaacgguucgaucagccucaugugccuagcguugggaggcgugcuaauauuccuaagcacagccguaagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7260 - RNA, 2524 nt, Artificial Sequence
  KU321639.1 prME-long mRNA Design 2 opt
ggggcgcugccuacggagguggcagccaucuccuucucggcaucaagcuuaccaugcgaauaauaaacgcaagaaaggaaaagaaacggcgcggcgcagacacauccgucggaauagugggacuccuacucacaaccgcaauggccgcggaaguaacaagaagaggcucagcguacuacauguaccuagaccgcaacgacgcaggagaagcaauauccuuccccacaacccucggcaugaacaaaugcuacauacagaucauggaccucggacacaugugcgacgcaaccaugagcuacgaaugcccaaugcuagaugaaggcgucgaacccgacgacgucgacugcuggugcaacaccaccuccacguggguagucuauggaaccugccaccacaagaaaggcgaagcccgaagaucaaggagagcagucacacuaccaagccacagcacacgaaaacuacaaacacguucacaaaccuggcucgaauccagagaauacacaaaacaccucauacgagucgaaaacuggauauucagaaaccccggcuucgcccucgcggcagccgcgauagcauggcugcugggaagcaguaccucacaaaaagucauauaccuaguaaugauccuccucaucgcgcccgccuacagcauucgcugcauagguguaagcaaccgggacuucguagaagggaugagcggcgguacaugggucgacaucguacuagaacacgggggcugcguuacaguaauggcacaagauaagcccaccguagacauagaacucgucacaacaaccguaucaaacauggcugaggucagaagcuacugcuacgaagcauccaucuccgacauggcaagugacagucgcugccccacccaaggagaagcguaccucgacaaacaauccgacacccaauacgucugcaaacgaacacucguagaccgcggauggggaaauggcuguggacuuuucggaaaaggcagccuaguaacaugcgccaaguucgccugcagcaagaaaaugacaggcaaaucaauccaaccagaaaaucucgaguaccgcauuauguuaucaguacacggcagccaacacagcggcaugaucgucaacgauaccgggcacgaaaccgacgaaaacagagccaaaguagaaaucacaccaaacagcccaagagcagaagccacacuugggggcuuuggcagccuaggccucgacugcgaaccacgaacaggccucgacuucucagaucuauacuaccucaccaugaacaacaaacacuggcucguacacaaagaaugguuccacgacaucccccuccccuggcaugccggggcagacacgggaacaccccauuggaacaauaaagaagcccuaguagaauuuaaagacgcccacgccaaaagacaaaccgucgucguccucggcagccaagaaggggccguccacaccgcucuagccggggcccucgaagcagagauggacggagccaagggacggcuaagcuccggccaccuaaaaugcagacucaagauggacaaacuaaggcucaagggggucucauacagcuuaugcacagccgcauucacauucaccaaaaucccggcagagacauuacacggcacagucaccgucgaaguacaauacgcaggcacagacggcccaugcaaagucccagcccaaauggcgguagacaugcaaacacucacccccgucggccgccuuaucacagccaacccagucaucaccgaaagcacggaaaacagcaagaugaugcucgaacucgacccacccuucggcgacucguacauaguaaucggagucggagagaaaaagauaacccaucacuggcaccgcagcggcuccaccauaggcaaagccuucgaagcgaccguacgcggcgcaaaacggauggccguacucggcgacacugccugggacuucggaucaguaggcggcgcccucaacucacuaggcaagggaauccaccaaaucuuuggcgcagccuucaaaagccuauucggcggaaugucgugguucagccaaauccucauaggcacguuacucauguggcucggccuaaacaccaaaaacggcuccaucucccuaaugugccucgccuuaggcggaguccugaucuuccucagcacagcaguaucggccgacguaggaugcuccguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7261 - RNA, 2524 nt, Artificial Sequence
  KU312312.1 prME-long mRNA Design 2 opt
ggggcgcugccuacggagguggcagccaucuccuucucggcaucaagcuuaccaugagaauaauaaacgcgcgcaaagaaaagaaacgacgcggcgcagacacaagugucggaaucgucggccuccugcugacgacagccauggcugcagaagucacacgcagaggaagcgccuacuacauguaccuagaccgaaacgacgcaggcgaagccauaucauucccaacaacgcucggcaugaacaaaugcuacauucaaauaauggaccuagggcacacaugcgacgcaacgaugagcuacgaaugccccaugcucgacgaaggagucgaaccagacgacguagacugcuggugcaacacgaccagcacgugggugguauacggaaccugccaccacaagaaaggggaagcacgaagaucacgacgcgccgugacccuccccagucacagcacacgaaaacuccaaacacgcucccaaacauggcuagaaucacgcgaguacacgaaacaccucauccgagucgaaaacuggaucuuuagaaacccaggcuuugcacucgcagcggccgccauugcauggcuacugggcaguagcacaucccagaaaguuauauaccucguaaugauacuucuaauagcgcccgcauacuccauccgcugcauaggaguguccaauagagacuucguagaaggaaugagcggaggcaccuggguagacguagucuuagaacacggaggcugcgucacagucauggcccaagacaaaccgaccguagauauagaacucguaaccaccacagucagcaacauggcagaagugcgaucauacugcuacgaagccucaaucuccgacauggccagcgacagccggugcccaacacaaggagaagccuaccucgacaaacaaucagacacccaauaugucuguaaacgcacacucgucgacagaggguggggaaacggcugcggccucuucggcaaagggucacucgucacgugcgcaaaauucgcaugcagcaagaaaaugacgggcaaauccauccaacccgaaaaccucgaauaccgaauaaugcucagcguccacgggucacaacacagcggaaugauagucaaugacaccggacacgaaacagacgaaaacagagcaaaaguagaaaucacaccaaacucaccgcgagccgaagccacacugggaggauucgggagucucggccucgacugcgaaccccggacuggccuagacuucuccgaccuauacuaccuaacgaugaacaacaaacauuggcucguccacaaagaaugguuccacgacaucccacucccguggcacgccggcgccgacaccggcacuccccacuggaacaacaaagaagcccuugucgaguucaaagacgcccacgcaaaacggcaaacaguaguagucuuagggucacaggagggcgccguucacaccgcccucgcuggggcgcuugaggccgaaauggacggcgccaaaggccgccucuccagcggacaccugaaaugccgacuuaaaauggacaaacuacgacuaaaaggagucuccuacagccucugcacagcagccuucaccuucacgaagaucccagccgaaacacuacacggaacagucacaguagaaguacaauacgcagggaccgacggcccaugcaaaguccccgcccaaauggccguagacaugcagacacuaacgcccguaggaagacucaucacagcaaacccgguaaucaccgaaagcaccgaaaacuccaaaaugaugcuggaacucgaucccccauucggagacagcuacauagucaucggaguaggagaaaagaaaauaacacaccacuggcaccgcagcggaucaaccauaggaaaagccuuugaagccaccguaagaggcgcaaaaaggauggcgguucugggggacacagcaugggacuucggcuccguaggcggcgcacuaaacucccucggcaaaggaauacaccaaaucuucggagcagccuucaaaucucucuucggcggaaugagcugguucagccaaauccuaauaggcacgcuacucauguggcuaggacuaaacgccaagaacggauccaucagccuaaugugccuggcucucggcggcguguuaauauuccuuagcacagcagucuccgccgacguaggcugcagcguagacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7262 - RNA, 2512 nt, Artificial Sequence
  AY632535.2 prME-long mRNA Design 2 opt
ggggcgcugccuacggagguggcagccaucuccuucucggcaucaagcuuaccaugcgcaucauaaacgcgcgcaaagaacgcaaacgaagaggcgcagauacaagcauaggaauaaucggacuccugcucacaacagcgauggcagcagagaucacacgaagggggucagccuacuacauguaccucgacagguccgacgcaggaaaagcaauaucauucgcaaccacacuaggagucaacaaaugccacguacaaaucauggaccuaggacacaugugcgacgccacaaugucguacgaaugcccgaugcuggacgaaggaguggaaccggacgacguagacugcuggugcaacacaacaaguacguggguggucuacggaacgugccaccacaagaaaggagaagcccgacgaagcagacgagcaguaacacugcccagccauucaacaagaaaauugcaaaccagaucccagacauggcuggaaagcagggaauacaccaaacaccucauaaagguagaaaacuggauauuccgaaaucccggauucgcacucguagccguagcaauagccugguuacugggcucaagcacaagccaaaaaguaauauaccuagugaugauacuccugaucgcccccgcguacucgauccgaugcauaggagucagcaaccgggacuuuguugaagggaugucaggaggaacauggguagacgucgugcucgaacacggaggcugugugacaguaauggcgcaagacaaacccacggucgacauagagcuaguaacaacaacuguaagcaacauggcagaagugagaagcuacugcuacgaagccucgaucucagacauggcaagcgauagccgaugcccuacgcaaggagaagccuaccuggacaaacagucagacacccaguacgucugcaaacggacacuggucgaccgcggcuggggcaacggcugcggccucuucgggaagggaucacucgugaccugcgcaaaguucacgugcagcaagaaaaugaccggcaaaagcauacaaccagaaaaccuagaauaccgaaucaugcucucaguacacggcucgcaacacucaggaaugaucggauacgaaacagacgaagaccgagcaaaaguagaagucacuccaaacagcccgcgcgcagaagcaacacuagggggcuucgggagccucgggcuagacugugaaccacgcacgggacuggacuucagcgaccucuauuaccuaacgaugaacaacaaacacuggcugguccacaaagaaugguuccacgacaucccacuuccguggcacgccggagccgacaccggcacaccccacuggaacaacaaagaagcccuagucgaguucaaggacgcccacgcuaaaagacaaaccgucgucguccucggcucacaagaaggagcgguccacaccgcgcucgcgggcgcucucgaagcggagauggacggugccaaaggacgcuuauucuccgggcaccuaaagugcaggcuaaaaauggacaaauuaagacucaaaggaguauccuacucgcucuguaccgcagccuuuaccuucacaaaggucccagccgaaacccuacacgggacagugacaguugaaguccaguacgccggcacagacggaccaugcaaaaucccgguacagauggcgguagacaugcaaacauugacaccagugggacgccucauaacugcuaacccaguaauaacagaaucaaccgaaaacaguaaaaugaugcuggagcuggacccgccauucggagacagcuacaucgugauaggaguaggagacaagaaaauaacacaccacuggcacaggagcggcagcaccaucggaaaagcauuugaagcgacagucaggggcgcgaaaagaauggcaguacuaggggacaccgcaugggacuuugggagcgugggaggaguuuuuaacagcuuaggaaaaggcauccaccagaucuucggagccgcauucaagagcuuguucggaggcaugagcugguucagccaaauacuaauagggacccuccuggucuggcuugggcugaacaccaaaaacggaagcaucagccugacaugccucgcacuaggaggcguaaugauauuccuaagcacagccgugagcgcggacguggggugcagcguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7263 - RNA, 2524 nt, Artificial Sequence
  KU527068.1 prME-long mRNA Design 2 opt
ggggcgcugccuacggagguggcagccaucuccuucucggcaucaagcuuaccaugcgaaucauaaacgcacggaaagaaaagaagagaagaggagcagacaccagcguagggaucgugggccugcuccucacaacggccauggccgccgaagucacccgcagaggaucagcuuacuacauguaccuagaccgcaaugacgcgggcgaagcaaucagcuuccccacgacccuaggcaugaacaaaugcuacauacaaauaauggacuuaggccacaugugcgacgcaaccaugaguuacgaaugcccgaugcuggacgaaggggucgaaccagacgacguagacuguugguguaacaccacaucaacaugggugguguacgggaccugccaccacaagaaaggcgaagccaggcgaucgagacgagcuguaacccuaccaagccacagcaccagaaaacuacaaacgagaucacaaacguggcuggagucacgcgaauacaccaaacaccucauccgaguugagaacuggauauuccgaaacccggguuucgcauuggcagcggccgccaucgccugguuacucggaagcucuacgagccaaaaggucaucuaccuaguaaugauccuccucauagcaccagcauacagcauccgcuguauuggcgucagcaacagggacuucguagaaggcaugagcgggggcacaugggucgacguaguacuugaacacggcggcugcgucaccguaauggcacaagacaaacccacagucgacaucgaacucguaacaacgaccguaagcaacauggcggaagugcgaagcuacugcuacgaagcaucaaucagcgacauggcgagcgacagcagaugcccuacccagggcgaagcauaccucgacaaacaaagcgacacacaauacguaugcaagagaacucuagucgaccgaggguggggcaacggaugcggacuauucggaaaaggcagccucgucacaugugcaaaauucgccugcucaaagaaaaugacagguaaaagcauacaacccgaaaaccuggaguaccgcauaaugcuaagcguacacgggucccaacacagcggcaugauagucaacgacaccggacacgagacagacgaaaaccgagccaaaguggaaauaaccccaaacagcccaagggcagaggccacccuaggaggguucggcagccucggccucgacugcgaaccacgcaccggccuagacuucucagaccuauacuaccucacaaugaacaacaagcacuggcucguacacaaagaaugguuccacgacaucccccuuccauggcacgcgggagccgacaccggaacgccccacuggaacaacaaggaagcgcucguggaguucaaagacgcccacgcaaaacgacaaaccgugguaguccuaggaagccaagaaggggcaguacacaccgcacucgccggagcacuagaagcggaaauggacggagcgaaagggagacucagcagcggacaccugaaaugucgacucaaaauggacaagcuacggcugaagggagugagcuauucccucugcacagcagccuucacauucacaaaaaucccggccgaaacacuacacggaaccgucacuguggagguacaauacgccggcacagacggccccugcaagguaccagcccaaauggcaguagacaugcaaacacucacaccagugggccgccuaauaacggcaaauccaguuauaaccgagagcacggaaaacuccaagaugaugcucgaacucgaucccccguucggagacucauacauaguaauaggcguaggggagaaaaagaucacccaccacuggcacagauccggcucgacaauaggaaaagccuucgaagccaccguacgcggagcaaaaagaauggcgguacuaggagacacagcaugggacuucggauccgugggcggagcccuaaacucccucggaaagggaauacaccagauauucggagcggcauucaaaucccuauucggaggaaugagcugguucagccagauccucauaggaacacuacuaauguggcuaggucucaacaccaaaaacggaagcauuagccucaugugccucgcacuaggcgguguacuaauuuuccuaagcacagccguaucagcggacguaggaugcagcguagacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7264 - RNA, 2524 nt, Artificial Sequence
  KU720415.1 prME-long mRNA Design 2 opt
ggggcgcugccuacggagguggcagccaucuccuucucggcaucaagcuuaccaugcggaucauaaacgccaggaaagaacgaaaacggagaggagcagacacgagcauuggcaucaucgggcuacuacuaacgaccgcgauggcggcggagaucacacgaagaggaagcgcauacuacauguaccuggacagguccgacgccggaaaagccauuucauuugccacaacacuagggguaaauaagugccacguacaaauaauggaucuuggacacaugugcgacgcaacaauguccuacgaaugcccaaugcuggaugagggcguagaaccagacgacgucgacugcuggugcaacacgacaucgacgugggucguauacggaacaugccaccacaagaagggggaagcacgaagaucgcggagagcaguaacacucccgagucacucgacacggaagcuacaaacaaggagccaaacauggcuggaguccagagaauacacaaagcaccuaauaaaagucgaaaacuggaucuuccgcaaccccgguuuugcccuagucgcagucgcaauagccuggcuacuaggcucaagcaccagccagaaaguaauauaucuagugaugauacuccugauagcgccagcguacagcauuaggugcauaggaguaagcaaccgcgacuucguagaaggcaugucgggcgggaccugggucgacgucguauuagaacacggaggcugcgucaccguaauggcacaggacaaaccaacaguagacaucgaacucguaaccaccacagucagcaacauggcggaggucagaagcuacuguuacgaggcaucuauaagugacauggccagugacagccgcuguccaacacaaggagaagcauaccuagacaaacaaucagacacacaauacgucugcaagagaacccuaguagaccggggaugggggaacgggugcggacuuuucggcaagggcucgcucguaacaugcgcaaaauucacgugcucgaagaaaaugacgggcaaaagcauccaaccagaaaaccucgaauacaggauaaugcuaucggugcacggcucacaacacucaggaaugauaguaaacgacaccggauaugaaacagacgaaaaccgggcaaagguagagguaacaccgaacagcccccgggcagaggcgacacuaggcggcuucggaagccuaggcuuagacugcgaaccaagaacaggccucgacuucucagaccucuacuaccuaaccaugaacaacaaacacuggcucguccacaaagagugguuccacgacauaccgcucccauggcacgcgggagccgacacaggaacaccgcacuggaacaacaaagaggcccuaguagaguucaaagacgcacacgcaaaaagacaaacaguaguagugcuaggcagccaagaaggcgccgugcacacagcccucgccggagcgcuggaagccgaaauggacggcgcgaaaggcaaacuguucuccggacaccuaaagugccggcucaaaauggacaagcugcgacucaagggcguaagcuacucccuguguacagcagccuucacauucacaaaagugccggccgagacccuacacgggaccgugacaguagaagugcaauacgccggaacagacggccccugcaagaucccgguacaaauggcagucgauaugcaaacacuaacacccgucgggagauugauaaccgcaaaccccguaauaacagaaaguacagagaacaguaaaaugaugcuagaacuggacccgcccuucggcgacagcuacauagucaucggcgucggagauaagaaaaucacacaccacuggcaccgaagcgggagcacaauagggaaagcguucgaggcaacagucaggggagcgaaacggauggccguacuaggcgauaccgcgugggacuucggaagugucggcggcguauucaacucacuagggaaaggaauccaccaaaucuucggagcagccuucaagagccuauucggcggcaugaguugguucucacaaauacugauaggcacacugcugguauggcuagggcuaaauaccaaaaacgggagcauaagccuaaccugccucgcacucgguggcgugaugaucuuccugagcacagccguaagcgcggacguagggugcagcguggacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7265 - RNA, 2506 nt, Artificial Sequence
  DQ859059.1 prME-long mRNA Design 2 opt
ggggcgcugccuacggagguggcagccaucuccuucucggcaucaagcuuaccaugagaaucaucaacgccaggaaagagcgaaaacgucguggagcagacacaucgauaggcauagucggccuacugcucacaaccgcaauggccgcagagauaacacgcagaggcucagcauacuacauguaccucgaccgaagugacgccggaaaagcaaucucauucgcaacaacacuaggcguaaacaaaugccacguacaaauuauggaccuaggucacaugugcgacgccaccaugucauacgagugcccgaugcuagacgaaggcguggaaccagacgacguagacugcuggugcaacacaacgagcaccugggucguauacgggacgugccaccacaagaaaggcgaagcaagacgaagccggcgcgccgugacacucccaagccacagcacccgaaaacuacagaccagaagccagacuuggcuagaaagccgagaauacaccaaacaccucaucaaaguagaaaacuggaucuucagaaacccaggguucacgcucguagccguagccauagccuggcucuuaggcucaagcacgucgcaaaaagucaucuaccuagugaugauacuccugauagcgcccgccuacagcauacgaugcaucggagucagcaaccgcgacuucguggagggcaugucaggagggaccugggucgacguaguccuggaacacggaggcuguguaacaguaauggcccaggacaaaccaacagucgacaucgaacucguaaccaccaccguguccaacauggcagaagucagaucuuacugcuacgaagccagcaucucagacauggccucagacucacgcugucccacacaaggagaagcguacuuagacaaacaaucagacacccaauacguaugcaaacgcacgcucgucgaucgagguuggggaaacggcugcggacuauucggcaaaggcucgcucguaaccugugcaaaauucacaugcagcaagaaaaugacaggcaaaagcauccaaccggaaaaccuagaauaccggaucaugcucucgguacacggcucccaacacagcggaaugauagucaacgacgagaaccgcgcaaaaguagaagucaccccaaacucuccccgcgcagaagcaacccuaggaggguucggaucccuaggcuuggacugcgaacccagaacaggacucgacuucagcgaccucuacuaccuaacaaugaacaacaagcacugguugguucacaaagaaugguuccacgacaucccucucccauggcaugcgggggcagacacagggacgccucacuggaacaacaaagaagcccuagucgaguucaaagacgcgcacgcaaaacgccaaacggucguaguacucggcagccaagaaggcgcgguccacaccgcgcuagccggcgcucucgaagcggaaauggacggagcaaaaggacgccuauucuccggccaccucaagugccgacuaaagauggacaaacuacgauugaaagggguauccuauucccucugcacagcagcauucaccuucaccaagguccccgccgaaacccuacacggcaccgucaccgucgaagugcaauacgcaggaaccgacggcccgugcaaaguccccgcacaaauggccgucgauaugcagacacuaacaccgguaggacgacugaucacugcgaaccccgugaucaccgaaagcaccgaaaacucaaaaaugaugcucgaacuagacccuccguucggcgacagcuacaucgucaucggggucggcgacaagaaaauaacccaccacuggcaccgcagcggaucaacuaucggcaaagcguucgaggccaccguaagaggcgccaaacggauggcaguacuaggcgauacagcaugggauuucggguccguaggaggcgucuucaacagccucggaaaaggcauccaccaaauauucggcgccgcguucaagagccuauuuggcggaaugagcugguucucacaaauccugaucggaacucuccuagucuggcuaggacuaaacacgaaaaauggaucaauaagccuaacaugccuggcacuaggaggcgucaugauauuccuaaguacagcagucagcgccgacgucggaugcagcguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7266 - RNA, 2524 nt, Artificial Sequence
  KX377335.1 prME-long mRNA Design 2 opt
ggggcgcugccuacggagguggcagccaucuccuucucggcaucaagcuuaccaugcgcaucauaaacgcgagaaaagaacgaaaacgccgcggggcggacacgagcaucggcauaaucggacuguugcuaacgaccgcgauggccgcggagaucacaagacgaggcagcgcguacuauauguaccucgaccgguccgacgccggaaaagccaucucguucgccaccacccuaggagucaacaaaugccacguccaaauaauggaccucggccacaugugcgaugccacaaugucauacgagugccccaugcuagacgaagguguagaaccagacgacguagacugcuggugcaauaccacgagcacguggguaguuuacggcacgugucacagaaagaaaggagaagccaggagaucaagacgcgcggucacccucccaagccacucaacacgcaaauuacagaccagaagccagaccuggcucgaguccagagaauacaccaaacaccugauaaaagucgaaaacuggaucuuucgcaaccccggauucgcacucguggcaguagcgauagcauggcuccuaggcagcagcacaucccaaaaagugauuuaucucgucaugauccuacugauagcaccggcguacagcaucaggugcauaggaguaaguaacagggauuuuguagaaggcaugucuggcggaacguggguagacgucguacucgagcacggaggcugugucacagucauggcccaagacaaacccacagucgacaucgagcucgucaccacgacagucagcaacauggcagaagugcgaucauacugcuacgaagcgucgaucagcgacauggcauccgacucgcgcugccccacgcaaggugaagcauaccuagacaagcaaucagacacacaauaugucugcaaacgcacccucgucgaccgaggauggggcaacggaugcggacucuuuggaaaaggaucccuaguaaccugcgccaaauuuaccugcagcaaaaagaugacgggcaagagcauccaacccgaaaaccucgaguacagaaucaugcuguccguccacggcucgcaacacucaggaaugauagucaacgacacaggcuacgaaacagaugaaaacagggcaaaagucgaagucacccccaacuccccacgcgcggaagccacccugggcggauucggcucccuaggccuagacugcgaaccacgcacaggacucgacuucagcgaccuguacuaccuaacaaugaacaacaaacacuggcuaguccacaaggagugguuccacgacauaccacuccccuggcacgcaggcgccgacaccggaaccccgcacuggaacaacaaagaagcacucgucgaguucaaagacgcacacgcaaagagacaaacgguaguaguccugggaucccaagaaggcgcaguacacacagcacuggccggcgcccuagaagccgaaauggacggcgcgaaaggaaaacuguucagcggccaccucaaaugccgccuaaaaauggacaaacuacgacucaaaggaguaucuuacucccuauguaccgcagccuucaccuucaccaaaguaccggccgaaacgcuccacggaacugugacagucgagguacaauacgccggcaccgacggacccugcaaaauaccaguacaaauggccguagacaugcaaacgcuaacgcccguaggacggcuaaucacagcgaaccccgugauaacagaaucaaccgagaacucaaaaaugaugcucgaacuagacccgcccuucggcgacagcuauauagugauaggcguaggcgacaagaaaauaacccaccacuggcacagaagcggauccaccaucggcaaagcguucgaagcaaccguaaggggcgccaaaagaauggcaguccuaggagauaccgccugggacuucggaagcgucggaggagucuucaacagccuuggaaaagggauucaccaaaucuucggagccgccuucaaaagccuauucgggggcauguccugguucagccaaauacuaaucggcacccuauuagucuggcucggccucaauaccaaaaauggcagcauuagccuaaccugccuagcacucggaggcgucaugaucuuccugagcacagccguaagcgccgacguaggcugcuccguagacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7267 - RNA, 2524 nt, Artificial Sequence
  LC002520.1 prME-long mRNA Design 2 opt
ggggcgcugccuacggagguggcagccaucuccuucucggcaucaagcuuaccaugcgcauaaucaacgccagaaaagaacggaaacgacgaggcgcggacacaucaauaggaaucauaggacugcugcugacaacagcgauggcggccgagauaacaagacgaggcucggccuacuacauguaccucgaccggagcgacgcagggaaagcgauaucauucgcaacgacacucggaguaaacaagugccacguacaaaucauggaccucggacacaugugcgacgccacgaugucauacgagugccccaugcuggacgagggcgucgaaccagacgacguagacugcuggugcaacaccacaagcacauggguaguauacggaaccugccaccacaagaaaggcgaagcgcgaaggucaagacgagcagucacccuaccaagccacagcacaagaaaacuccaaacccgcucacaaaccuggcuagaaagccgagaauauaccaaacaccucaucaaaguagaaaacuggauauuccgcaacccaggcuucgcacucguggcaguagccauagcaugguuauuaggcaguagcacuagccaaaagguaaucuaccuagucaugauacuccuaaucgcgcccgcguacucaaucagaugcaucggaguaagcaacagagacuucguagaagggaugucagggggaacauggguagacgucguacuagaacacggaggaugcgucacgguaauggcccaggacaagccaaccgucgacauagagcucgugaccacuaccguaagcaacauggcggaaguacgaucauauugcuacgaagccucaauaucagacauggccucugacagccgcugcccaacacaaggagaagcguaccuagacaagcaaagcgacacgcaauacgucugcaaacggacacucguagaccgcggauggggaaacggcugcggucuauucggaaagggcucgcucguaaccugcgcaaaauuuaccugcucaaagaaaaugacaggcaaaucaauucagccggaaaaccucgaguacaggaucaugcucuccguacacggcucacaacauagcggcaugacagucaacgacauaggauacgaaacugacgaaaacagggccaaagucgaaguaacgcccaacagcccaagagcagaagccacacugggaggauucggcagcuuaggccuggacugcgaaccgcgaaccggauuggacuucucagaccucuacuaccuaaccaugaacaacaaacacuggcuaguccacaaagaaugguuccacgacauaccacuaccguggcacgcaggcgcagacaccgggaccccgcacuggaacaacaaagaagcgcuggucgaguucaaagacgcgcaugccaaacgacaaaccgucguggucuuaggaucccaagaaggcgcgguccacacggcacuggcaggcgcucucgaagccgaaauggacggagcaaaaggaaagcuauucagcggccaccucaaaugcagacucaaaauggauaaacugaggcucaaagggguaucguacucccugugcacagcagccuucaccuucacaaaaguccccgcagagacccuccacggcacagugacaguggaaguccaauacgccgggacagacggaccaugcaaaaucccaguccagauggcaguagauaugcaaacacugacacccguaggaagacuaaucacggcaaaccccgugauaacagaaucgacagaaaacuccaaaaugaugcuggaauuagacccacccuucggcgauagcuacaucguaauaggagucggggacaagaaaauaacacaccacuggcaccgcagcggaagcaccaucggcaaagcauucgaggcgacggucagaggcgcaaaacgaauggcggucuuaggagacacagcaugggacuucggguccgugggagggguguucaacucacuaggaaaaggaauccaucaaaucuucggagccgcauucaaaagccuauucggagggauguccugguucucacaaauacuaauaggcacacugcugguauggcuaggacucaacaccaaaaacgggagcauaagccuaaccugccucgcacuagggggaguuaugaucuucuugagcacggccgucagcgcagacgucggcugcucaguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7268 - RNA, 2512 nt, Artificial Sequence
  KU963573.2 prME-long mRNA Design 2 opt
ggggcgcugccuacggagguggcagccaucuccuucucggcaucaagcuuaccaugcgcauaaucaacgcccgcaaagaacgcaaacgaagaggcgcagacacaagcauaggcaucaucggccuccuccucacaaccgccauggcagcagaaauaacccgcagaggaagcgccuacuacauguaccuagaccgcuccgacgcaggcaaagccauaucauucgcaacaacccugggaguaaacaaaugccacguccaaauaauggaccugggccacaugugcgacgccacgauguccuacgaaugcccaauguuagacgaaggaguagaacccgacgacgucgacugcugguguaacacaacuagcacauggguagucuauggaaccugccaccacaagaaaggagaagcaagacgaucccgccgcgcggugacccugccaagccacucaacacgaaaacuacaaaccagaucccaaaccuggcucgaaucacgugaauacaccaaacaccucauaaaggucgagaauuggauauuccgaaacccaggcuucgcccuaguagcaguagcaauagcauggcugcucgggaguagcaccagccaaaaggucaucuaccuagucaugauacuacucauagccccagcauacagcauccgaugcauaggaguauccaaccgcgacuucguagaagggaugagcggaggcaccuggguagacguaguccucgaacauggaggaugcguaacgguaauggcacaggacaagcccacggucgacauagaauuagugacgaccacaguauccaacauggccgagguacgaaguuacugcuacgaagcgucaauauccgacauggcgagugacucgcgcugccccacacaaggggaggcuuaccucgacaaacagagcgacacacaauacgucugcaaacgaacccuagucgaccgcggaugggguaacggcugcggacuauuuggcaaaggcagccuagugaccugcgccaaauucacauguuccaaaaagaugacuggaaaauccauacaaccagaaaaccucgaauaccgcaucaugcuauccguacacggcucacaacauucaggcaugauaggguacgaaacagacgaaaaccgcgccaaaguagaagucacaccaaacagcccaagagcagaggccacacuaggaggcuucggaucccucggacucgacugcgagccgcgaaccggccucgacuucucggaccuauacuaccucacaaugaacaacaaacacuggcucguccacaaagaaugguuccacgacaucccccugccauggcacgcaggcgcagacaccggaacaccgcacuggaacaacaaagaagcacugguagaguucaaagacgcccaugccaaacgccaaacaguaguaguucugggaucccaagaaggcgcaguccacacugcccucgcgggcgcccucgaagcagaaauggacggcgcuaaaggcaaacuauucuccgggcaccucaaaugucgacuaaaaauggacaaacuccgacuaaaaggcguaagcuacucucucugcaccgccgcguucacguucacaaaaguccccgccgaaacacuccacggcacagucaccgucgaaguccaauacgccggaaccgacggacccugcaaaauacccgugcagauggcaguagacaugcaaaccuuaacaccagucggacgccucauaaccgcaaacccagucaucacagaaagcaccgaaaacuccaaaaugaugcuagaacucgacccgcccuucggcgacuccuacaucgugauaggcgugggggacaagaaaaucacacaccacuggcaccgaagcggcagcacaaucggaaaagccuucgaggccacagucagaggcgcaaaaagaauggccgugcuaggagacaccgcaugggacuucgguuccguaggcggcguauucaacagccucggcaagggaauccaccaaaucuucggcgcggcuuucaaaagccucuucggcggcauguccugguucucacagauccugaucggcacacuccucgucuggcuaggccuaaacaccaaaaacggcucgauaaguuuaacaugccucgcacugggcggagucaugaucuuccucucaaccgcaguuagcgccgacguaggaugcagcguagauuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7269 - RNA, 2524 nt, Artificial Sequence
  KX694534.2 prME-long mRNA Design 2 opt
ggggcgcugccuacggagguggcagccaucuccuucucggcaucaagcuuaccaugagaaucaucaacgcacgaaaggaaaagaaacgcagaggagcagacacaagcgucggcauaguaggacuccuacuaacaacagccauggccgcagaagucacaagaaggggaagcgcauauuacauguaccucgaccgcaacgacgcuggcgaagccaucagcuucccgaccacccuaggcaugaacaaaugcuauauacaaauaauggaccucggccauaugugcgacgcaacaaugagcuacgaaugccccaugcucgacgaaggcgucgaaccagacgacgucgacugcuggugcaacacaaccucaacaugggucgucuacggcacgugccaccacaaaaagggagaagccagacgcucccgacgagccguuacccucccuagccacagcacgagaaaacuccaaacacgaucacaaaccuggcuugaaagccgcgaauacaccaaacaccucauccgcguggaaaacuggauauuccgaaaucccggcuucgcccucgcagcagccgcgaucgcauggcuccuuggcuccuccacgucccagaaagucaucuaucucgucaugauccuacuuaucgcgccugcauacuccauaagaugcaucggcguaagcaacagagacuucgucgaaggcauguccggcggcaccugggucgacgucguccuagaacacggggguugcguaaccgucauggcucaggacaaaccaacagucgacaucgaacugguaacaacgaccgucagcaacauggccgaaguacgcagcuacugcuaugaggcuucaauaagcgacauggccagcgacagccggugcccaacacaaggagaagccuaccuagacaaacaaucagacacccaauacgucuguaagagaacccugguggaccgcggauggggaaacggcugcggauuguucggcaagggcucccuaguaacaugcgcaaaauucgccugcuccaagaaaaugaccggcaaaucgauccaacccgaaaaccucgaauaccgcauaaugcuauccguccacggcucacaacacucaggcaugauaguaaacgacaccggacacgaaacagacgaaaauagagcgaaaguggagaucacucccaacagcccaagagcggaagccacacuaggaggcuucggcucccuaggacucgacugugaaccacgaaccggacucgauuucucggaccucuacuaccuaacaaugaacaacaaacacuggcucgugcacaaagaaugguuccacgacauaccccucccuuggcacgcaggagcagacaccggcaccccacacuggaacaacaaagaagcccucguagaguucaaagacgcccacgccaaaagacaaacaguuguaguacugggcagccaagaaggagccgugcacaccgcccuagccggagcccuagaagccgaaauggacggggcuaaaggccguuuauccagcggccaccuaaaaugcagacuaaaaauggacaaacuaagguuaaaaggcguaagcuacucccuaugcacggcggcauucaccuucacaaaaauccccgcagaaacccuccacggaacagucacaguggaaguucaauacgccggcacagacggacccuguaagguaccagcacaaauggcugucgacaugcagacucugacaccaguugggcgacucaucaccgcaaaccccgucaucacugaaagcaccgaaaacuccaagaugaugcuagaacuugacccaccauucggagacagcuacauaguaauuggcgucggcgaaaagaaaaucacacaccacuggcacagaagcggcagcacgauagguaaagcauucgaagcaaccguaaggggcgccaaacgaauggcagugcucggagacaccgccugggacuucggaagcguaggaggcgcccugaacucacuaggccgaggcauacaucaaauauucggggcagcauucaaaagccucuucggcggcaugagcugguucagucaaauacuaauagggacacugcuaauguggcuaggacugaacaccaaaaacggcucaauaucacuaaugugccuagcacucggaggcgugcuaauauuccuaagcacagcagucucggcagacguaggaugcagcguagacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7270 - RNA, 2524 nt, Artificial Sequence
  KX447520.1 prME-long mRNA Design 2 opt
ggggcgcugccuacggagguggcagccaucuccuucucggcaucaagcuuaccaugcgcaucaucaacgcaaggaaggagaaaaagcgacgaggcgcagacgcgagcgucggcauaguaggccuccugcucacaaccgcgauggccgccgaggucacacgcagaggcucggccuauuacauguaccucgacagaaaugacgcaggcgaagccaucucauucccgaccacacucggaaugaacaaauguuacauacaaaucauggaccuagggcacaugugcgacgcaacuauguccuacgaaugcccgaugcucgacgaaggaguagaaccagacgacguagauugcuggugcaacacaacaagcacauggguagucuauggcacgugccaccacaaaaagggggaggcgaggaggagcagaagggcaguuacacucccaagccacagcacgcgcaaacuacaaacaaggagccagaccuggcuugaaagcagagaauacacaaagcaccugaucagggucgaaaacuggauauuccgcaacccggguuucgcacuagcagcagcagcaaucgcauggcuccuaggaagcagcacgucccaaaaaguaauauaccucguaaugauacugcucaucgccccagcuuauucaaucaggugcaucggcgugagcaacagagacuuuguggaaggaaugucaggcggcacgugggucgacgucguucuagaacacggaggaugcgucacaguaauggcucaggacaaaccaacagucgacauagagcuaguaacaacaaccguaagcaacauggcagaaguucgcaguuacugcuaugaagccucgaucucagacauggccucagacucgagaugccccacacaaggagaagcguaccuagacaaacaaucagacacccaauacguaugcaaaaggacccuaguagaccgcggaugggggaacgggugcggacuauucggaaagggaucgcucguaaccugcgcaaaauucgccugcagcaaaaagaugacuggcaaaagcauacaacccgaaaaccuggaauacagaaucaugcuaucaguccacgggagccaacacucaggcaugauaguaaacgacacgggccacgaaacagacgaaaacagagcuaaaguagagauaacacccaacagcccacgagcggaagcgacacuaggagguuucggaagccuaggccuggacugcgaaccgcgaacaggccucgauuucagcgaucucuacuaccugaccaugaauaacaaacacuggcucguacauaaagagugguuccacgacauaccgcuaccauggcaugccggagcagacaccggaacaccccacuggaacaacaaagaggcccuagucgaguucaaagacgcgcacgccaaaagacaaacaguggugguacugggaucgcaggagggcgcgguccacacugcacucgccggcgcgcuagaagccgagauggacggagcaaaaggacgccuaagcagcggacaccucaagugccgacuaaagauggacaagcuccgccuaaaaggggucucguacagucucugcacggcagcauucaccuucacgaagaucccggcggaaacacugcacggaaccguaacaguagaagugcaauacgccgggaccgacggcccgugcaaagucccggcccaaauggcaguagacaugcaaacgcuaacaccaguaggaagacugaucacugccaacccaguaaucacagaaucgacagagaacucaaaaaugaugcuagaauuggacccgcccuuuggcgacagcuacaucgugauaggaguaggggaaaagaaaauaacacaccacuggcaccgaagcggaagcacaaucgggaaagccuucgaggcaacaguccgaggcgcaaagagaauggcaguccuuggagacacggcaugggacuucggaagcgucgggggcgccuugaacucacuaggcaaagggauccaccaaauauucggagccgcguucaagagccucuucggcggcauguccugguuuucacaaauacucaucggaacauuacugauguggcucgggcuuaacaccaagaacggcucaauaagccugaugugccucgcccuagggggcguacucauauuccuguccacggccgucagcgccgacguaggaugcagcguagauuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7271 - RNA, 2524 nt, Artificial Sequence
  KX369547.1 prME-long mRNA Design 2 opt
ggggcgcugccuacggagguggcagccaucuccuucucggcaucaagcuuaccaugcgaaucaucaaugcacggaaagagaaaaagcgccgaggggccgacacgagcgucgggaucguaggccuacugcugaccaccgcaauggccgcagaagucacacgacgaggcagcgcauacuacauguaccucgacagaaacgacgccggagaagccaucucauuccccacaacacucgggaugaacaaaugcuacauccaaauaauggaccuaggacacaugugcgaugcaaccaugagcuacgaaugcccaaugcucgaugaaggcguugaaccagacgacguggacugcuggugcaacacaacuagcaccugggucgucuacggcacaugccaccacaagaaaggggaggcacgcagaagucgacgggccguaaccuuacccagccacuccacaagaaaacuacaaacacgcucacaaaccuggcuggaaagucgagaauacaccaaacaccucauccgaguggaaaacuggaucuucagaaacccgggacuagcacuagccgccgcagcaaucgcauggcuacuaggaagcuccacaagccaaaaagucauauaccucgucaugauccuacugaucgccccagcauacaguauacgcugcauaggagugagcaacagagacuucguagaaggcaugucaggaggaacgugggucgacguaguccucgagcacggcggcugcguaaccguaauggcacaagacaaacccaccguagacauagaacucgucaccacaaccguuagcaacauggcagaggucaggucuuacugcuacgaagcaagcauaagcgacauggcauccgacucaagaugccccacccaaggcgaagcauaccuagacaaacaauccgacacacaauacguaugcaaacgaacccuaguagaccggggcuggggcaacggcugcggacuauucggcaaagggagccuagucacaugcgcaaaauucgcauguuccaagaaaaugaccggcaaauccauccaaccagagaaccucgaguaccgcauaaugcugucaguacacggcucccaacacuccggaaugauagugaacgacaccggccacgaaaccgacgagaacagagccaaagucgaaauaacacccaacucaccccgggcagaggcaacccucggaggcuucggcagucucggacucgacugcgaaccccguaccggucucgacuuuucagaccuauacuaccuuacuaugaacaacaaacacuggcuagugcacaaagagugguuccacgauaucccccuaccauggcacgccggggccgacaccggcacaccacacuggaacaacaaagaagcgcucgucgaguucaaagacgcgcacgcaaagcgccaaaccgugguaguccuaggcagccaagaaggggcaguccacacagcacuagccggagcgcuggaagcagaaauggacggagccaaaggccgccuauccagcggacaucuaaaaugcagacuaaaaauggacaaacuccgucucaaaggaguauccuacagccucugcacagcagcuuucaccuucacgaagauccccgccgaaacccuccacggcacagucacagucgaaguccaguaugccggaacagacggaccaugcaaagugccggcccaaauggccguggacaugcaaacacuuaccccaguaggccggcuaaucacagcaaacccagugaucaccgaaagcaccgaaaacuccaaaaugauguuagaacuggacccacccuucggcgauuccuacaucgucaucggcgugggcgaaaagaaaaucacacaccauuggcaccgaagcggcuccaccaucggaaaggcauucgaagccaccguaagaggcgccaagcgcauggcaguacuaggagacacagcgugggacuucggcagcgucggaggagcucuaaacagccugggaaaggguauacaccaaaucuucggagcggccuucaaaagccucuucgggggcaugucaugguucagccagauccuaaucggaacccuacuaauguggcucggccuaaacaccaagaacggaagcauaucgcugaugugcuuagcacucggcggaguacuuaucuuccucucaacagccguauccgccgacgucggcugcagcgucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7272 - RNA, 2524 nt, Artificial Sequence
  KX447515.1 prME-long mRNA Design 2 opt
ggggcgcugccuacggagguggcagccaucuccuucucggcaucaagcuuaccaugcggaucaucaacgcacgcaaagagaagaaacgacggggagccgacaccucaguaggcaucgugggacuacuucucacaacggcaauggcagccgaaguaacacgcagaggaagcgccuacuacauguaccuagaccgcaacgacgccggcgaagcaaucagcuuccccacaacccuaggaaugaacaaaugcuacauacaaauaauggaccucggccacaugugcgacgccacaaugucauacgaaugccccaugcuagacgaaggaguagaacccgacgacgucgacugcuggugcaacacgacaagcaccuggguuguauacggaaccugccaccacaagaaaggcgaagcacgccgcucacggagagccguaacccuccccucacacagcacaagaaaacugcaaacacggucgcaaaccuggcuagaaucacgcgaauacaccaaacacuuaauccgagucgaaaacuggauauuccgcaauccaggcuucgcacucgccgcagccgccaucgcauggcuacugggaagcuccacaagccaaaaaguuaucuaccucguaaugauccuacuaaucgcccccgcuuacucgauacggugcauaggaguaucgaacagggacuucguagagggcauguccggcggcacaugggucgacgucgucuuagagcacgggggcugcguaaccgucauggcucaagacaaaccgaccguggacaucgaacucguaaccacaaccgugagcaacauggccgaaguaagaagcuauuguuacgaagcaagcaucucagacauggcaagcgacagcagaugcccaacccagggagaagcauaccuagacaaacaaucagauacacaauacgugugcaaaaggacacucguagacagaggaugggggaacggaugcgggcuuuucggaaaaggaucacucgucacaugcgcaaaauucgcaugcagcaagaaaaugacaggcaaaucaauccaacccgagaaccuggaauacagaauaaugcuauccguccacgggagccaacacuccggaaugauaguaaacgacacaggacacgaaacugacgagaaccgagccaaagucgagaucacaccaaacagcccacgcgcggaagccacacucggcggauucggaucccucggccucgacugcgagccacgaaccggccuagacuucucggaccuauacuaccuaaccaugaacaacaaacacuggcuggugcacaaagaaugguuccaugacauaccgcuuccauggcacgcaggagcagacaccggcacaccccacuggaacaacaaagaagcgcuuguugaguucaaagacgcccacgccaaaagacaaaccguaguaguacucggcagccaagaaggugccguacacacagcgcuugccggcgcccucgaagcagaaauggacggcgcaaaaggacgccuuagcagcggccaccuaaaauguaggcucaaaauggacaaacuaagacuaaaaggggucuccuauucccuaugcacggcagcauucaccuucacgaaaauccccgcagaaacccuccacggaaccguaacagucgaaguacaguacgcaggaaccgacggaccgugcaaagucccagcccagauggcaguggacaugcaaacccugacgccagucggccgacucaucaccgccaacccugugaucacggagagcacagaaaacagcaaaaugaugcucgaacucgacccacccuucggcgacucguacauagucauaggcguaggcgaaaagaaaauaacacaccacugguaccgcuccggcagcacaaucgggaaagcauucgaagccacagucagaggggcgaaacgcauggccguacuaggagacacagccugggacuucggcagcguaggaggcgcacuaaacagccuagggaaaggcauacaccaaaucuucggagccgccuucaaaagccuauucgguggaauguccugguucucccaaauacuaauaggcacacuccuaauguggcucggacuaaacaccaaaaacggaucaaucucccuaaugugucucgcccuaggcggaguacucauauuucuauccacagcagucagcgcagacguaggguguucagucgacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7273 - RNA, 2524 nt, Artificial Sequence
  KU501217.1 prME-long mRNA Design 2 opt
ggggcgcugccuacggagguggcagccaucuccuucucggcaucaagcuuaccaugcgaaucauaaacgcccggaaagaaaagaaacgccgcggagccgacaccuccgucggaauaguaggccugcugcucaccacggccauggcugccgaagugacccgccgaggaagugccuacuacauguaccucgacagaaacgacgcaggcgaagcaaucagcuuccccacaacguuaggcaugaacaaaugcuauauacagauaauggaccugggccauaugugugaugcaaccaugucauacgaaugccccaugcucgacgaaggagucgaaccagacgacguagauugcuggugcaacacaaccucgacauggguagucuauggaacaugccaccacaagaaaggcgaagcccgccgcucaagacgagcgguaacgcuaccuucgcauuccacacgaaaacuacaaacccgcucccaaacauggcuagaaagccgagaauacacaaaacaccucaucaggguagagaacuggaucuuccgcaacccaggcuucgcacucgccgcagcagccaucgccuggcuacuaggaagcagcacaucgcaaaaaguuaucuaccucguaaugauccuccuuaucgccccggccuacagcauacgcugcaucggggucuccaacagagacuucgucgaaggcaugagugggggcacguggguagacgucguacuagaacacggcggaugcgugaccgucauggcacaagacaaacccaccguggacauagagcuaguaacaaccacuguaucgaacauggccgagaucagaagcuacugcuacgaagccuccauauccgacauggccagcgacagcagaugcccgacacaaggagaagccuaccucgacaaacaaagcgacacacaauaugucugcaaacgcacccuagucgacagaggcuggggcaacgggugcggccucuucggcaaaggaagccucgucacaugcgcgaaauucgcaugcuccaaaaagaugaccggaaaaucgauacaacccgagaaccucgaauaccgaaucaugcuaaguguccacggcagccaacacucaggaaugaucgucaaugacaccggacacgagacagacgaaaaccgagccaaaguagaaauaaccccaaacucaccacgggcagaggcgacgcuaggcggauucggcucccugggccucgacugcgaaccacggaccggacucgacuucagcgaccuauacuaccucacgaugaacaacaaacacuggcuaguacacaaagaaugguuccacgacaucccacugccauggcacgcaggcgcagauacaggcacaccccacuggaacaacaaagaggcccuaguagaguucaaagacgcacacgccaaaagacaaaccguagugguacucggcagccaagaaggcgcaguacacacagcacucgccggcgcacuggaagcagaaauggacggagccaaaggccggcuauccagcggccaccugaaaugccgccucaaaauggacaagcucaggcucaagggaguaagcuacagccuaugcaccgcagcauuuaccuucacaaaaauccccgcggaaacucugcacggcaccgucacagucgagguucaauacgcaggcaccgacggcccaugcaagguccccgcacaaauggcuguggacaugcaaacacucaccccugucggcagacucauaaccgccaacccagucauaaccgagagcacagaaaauuccaaaaugaugcuagaacuagacccucccuucggggacagcuacaucgucaucggcguaggggagaaaaagaucacccaccacuggcaccggucaggcucaaccauaggcaaagccuucgaagcaacaguaagaggagccaaacgcauggccguacugggagauacagccugggauuucggaucugucggaggcgcacuuaacagccuuggcaaaggcauccaccaaaucuucggcgccgccuucaagucccucuucggcggaaugagcugguucagccaaauccuaaucggcacccuccuaauguggcucggacucaacaccaaaaacgguuccaucucauuaaugugccuagcccucggagguguccucauauuccuauccaccgcagucuccgccgacguaggcuguagcgucgacuucucuaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7274 - RNA, 2524 nt, Artificial Sequence
  KU312314.1 prME-long mRNA Design 2 opt
ggggcgcugccuacggagguggcagccaucuccuucucggcaucaagcuuaccaugcgcaucaucaacgcaagaaaagaaaagaaacgcaggggagcagacaccucggucggcauagucggacuccuacucaccaccgccauggcugcugaaguuacacgcagaggaucggccuacuacauguaccuggaccgcaacgacgcaggggaggccauaucguuccccaccacacuuggaaugaacaaaugcuacauacaaaucauggaccucgggcacaugugcgacgcaaccauguccuacgaaugccccaugcucgacgaaggaguagaaccagacgaugucgacugcuggugcaacaccacgagcacaugggucguuuacggcacaugccaccacaagaaaggugaagcccgccgcagucgacgagccgucacccuuccaagccacuccacacgaaaacuccaaaccaggagccaaaccuggcucgaaagccgagaauacaccaaacaccucauaagaguagagaacuggauauuccgcaacccaggcuucgcccucgcagccgccgccaucgcguggcuccuaggcaguagcaccagccaaaaagugauauaccuagucaugauacuacugaucgcaccagcauacucaauccggugcauaggaguaucuaaccgagacuucguagaaggcaugucaggagggacauggguggacguaguccucgaacacggagggugcguaacaguaauggcccaagacaaacccaccgucgacaucgagcuagucaccacgaccgucagcaacauggcagaaguccgguccuacugcuacgaagcaagcaucucggacauggccagugacucccgcugccccacgcagggcgaagcauaccucgacaaacaauccgacacccaauacgucuguaaacgcacacucguagaccgcggcuggggaaacggcugcgggcuauucggaaagggcagcuuagucacaugcgccaaguuugcaugcucaaagaaaaugaccggcaaaagcauacaacccgaaaaccucgaauaccguaucaugcuguccguacacggaucacaacacagcggaaugaucgucaacgacaccggccacgaaacagacgaaaacagagcaaaagucgaaauaacucccaauagcccacgcgcagaggccacacugggcgguuucggcagccugggccuagacugcgaaccccgcacaggccucgacuuuuccgaccucuacuaccucaccaugaacaacaaacacuggcucguccacaaagaaugguuccaugacaucccccucccauggcacgccggcgccgacaccggaaccccacacuggaacaacaaagaagcccuagucgaguucaaagacgcccacgcgaaacgacaaaccguaguaguacucggcagccaagaaggcgcaguucauacggcccucgcgggagcacucgaagcugaaauggacggcgcaaaaggacgacucucaucaggacaucugaaaugccgacucaaaauggacaaauuaagacucaaaggcguauccuacucgcucugcacggcagcauucacguuuacaaaaauaccagcagaaacccugcacggcaccguuaccguagaaguccaauacgccgguaccgacggcccgugcaagguccuagcacaaauggcagucgacaugcaaacauugacacccgucggccgacugaucacagcaaaccccgugaucaccgaaucaaccgaaaacuccaaaaugaugcucgaacuggacccaccauucggcgauagcuauaucgucaucggagucggcgaaaagaaaaucacccaccacuggcaccgauccggcuccacaaucggaaaagcauucgaagcaacaguacggggcgcaaaacggauggcaguccucggcgacacagccugggacuucggcagcgucggcggcgcccucaacagccuaggcaaaggcauccaccaaauauucggugcagccuucaagagccucuucggaggaaugagcugguucagccaaauacucaucggcacacuccuaauguggcugggccucaacaccaaaaacggcagcauaagccucaugugucuggcccuaggaggaguacuaauauuccuauccacugccgucagcgcagacguuggcugcagcguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7275 - RNA, 2524 nt, Artificial Sequence
  KX446950.2 prME-long mRNA Design 2 opt
ggggcgcugccuacggagguggcagccaucuccuucucggcaucaagcuuaccaugcgcaucaucaacgcacgaaaggagaaaaaacgccgaggggccgauaccuccguuggcaucgugggacuccuccuaacuacagcuauggccgcggaagugacccgccgcggaagcgcuuacuacauguaccuagaucgcaacgacgccggcgaagccaucucauucccaacgacacugggcaugaacaaaugcuacauccaaaucauggaccuaggccacaugugcgacgccaccaugucuuacgaaugucccacacuugacgaaggcguagagcccgacgacguagacugcuggugcaacacgacgucaaccuggguuguauacggcacaugccaccacaaaaagggagaagccagacgcagcagaagagccgucacacuacccagccacucgaccagaaaacuacagacccgcagccaaacauggcuggaaucccgcgaauacacaaaacaccuaauacgcguagaaaacuggauauucaggaacccgggcuucgcccuagccgcagcagcaaucgccuggcuccuaggcuccuccacaucccaaaaagucauauaucucgucaugaucuuacucaucgccccagccuacucuauacgcugcaucggcgucuccaaccgcgacuucgucgaaggcauguccggaggaacauggguagacguaguacuggagcacgggggaugcgucacaguaauggcccaagacaaacccaccguagacauagaacuagucaccaccacagucucaaacauggccgaaguccgcucauacuguuacgaagcaagcauauccgacauggccuccgacucgcggugcccaacccaaggcgaggccuaccuagacaaacaaagcgacacccaauacgucugcaagcguacgcugguggaccguggauggggaaacggaugcggacuauucggcaaaggcagccucguuaccugcgcaaaauucgccugcuccaaaaaaaugacaggcaaaucgauucaacccgagaaccucgaauaccgaauaaugcuaagcguccacggaucacagcacuccggcaugaucgucaacgacaccggacacgagacagacgagaaccgcgcaaaaguggaaaucaccccgaacuccccccgugcagaggcaacccuaggcggcuucggcucacucggacucgacugugaacccagaaccggccucgacuucuccgacuuguacuaccucacaaugaacaacaaacacuggcuaguccacaaagaaugguuccacgacaucccccuccccuggcacgcaggagcggacaccggaaccccacacuggaacaacaaagaagcccucgucgaguucaaagaugcccacgcaaaacgccagacagucgucguccuaggaagccaagaaggagcaguacacacagcacucgcaggagcccuagaagccgaaauggacggugcaaaaggcagacucagcagcggacaucucaaaugcagacuuaaaauggacaaacuccggcucaaaggcgucagcuacagccucugcacagcagccuucacauucacaaaaauccccgcggaaacccuccacggcacuguaacggucgaaguccaauacgcaggaacggauggcccaugcaaagucccagcccaaauggcagucgacaugcaaacccucacccccgucggccgucucauaaccgcaaacccggucaucacagaaagcaccgaaaacagcaaaaugaugcuggaacuagacccacccuucggagauuccuacaucgucaucggcguaggcgaaaaaaaaauaacccaccacuggcacagaucagguucgacaaucggaaaagcguucgaagccaccguaagaggcgccaaacgcauggccguccucggagacaccgcaugggacuucggaucuguagguggagcccuuaacucccuaggcaaagguauccaccaaaucuuuggagcugcauucaaaucacuauucggcggaaugucaugguucagucaaauacucaucgggacccuacucauguggcuaggccuaaauaccaaaaacgggucgauaucacuaaugugccucgcacucggcggcguacucauauuucucucaaccgcgguaagcgcagacgugggaugcucagucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7276 - RNA, 2524 nt, Artificial Sequence
  KY003157.1 prME-long mRNA Design 2 opt
ggggcgcugccuacggagguggcagccaucuccuucucggcaucaagcuuaccaugcgaauaauaaaugcacgaaaggaaaagaaacgaagaggagcagacacauccguaggaauagugggacuacuacuaaccacggccauggcagcagaaguaaccaggaggggaucggccuacuacauguaccucgacagaaacgacgcaggagaagcaaucuccuuccccacaacacucggaaugaacaaaugcuacauccagauaauggaucuuggacacaugugcgacgccacaaugagcuacgagugccccauguuagacgaaggcguugaaccagacgacgucgauugcuggugcaacacaaccucaacuuggguagucuacgggacaugccaucacaagaaaggggaggcccgcagguccagacgagccguaacacuccccagccauucaacacgcaaacuccagacgcgcagccagaccuggcucgaaagccgagaauacacaaaacaccuaauccgcguagaaaacuggauuuuuagaaaccccggauucgcacucgcagcagcggcuauagccuggcuccucggauccagcaccagccaaaaaguaaucuaccucguaaugauccugcucaucgccccagcauacagcauccgaugcaucggagugagcaacagagacuucguagaaggcaugucaggcggcaccuggguagauguaguacucgaacacggaggaugcguaacgguaauggcccaagacaaaccaacaguggacaucgaacucgugaccaccaccgucuccaacauggcagaaguacggucauacugcuacgaagccucaaucagcgacauggcaagcgacuccagguguccgacccaaggcgaagcauaccucgacaaacaaagcgacacccaauacgucugcaaacggacccuaguagaccgaggcugggguaacggcugcggccucuuuggaaaaggaagccucguaacaugcgccaaauuugccugcagcaaaaagaugacagggaaaagcauacaaccagaaaaccuagaauacagaauaaugcucuccguccacggcagccaacacucaggcaugauaguaaacgacaccggacacgaaacggacgagaacagagccaaagucgaaauaaccccaaacagcccacgcgccgaagccacgcucgggggcuucggaucauugggauuagacugugaaccccgcacaggucucgauuucagcgaccucuauuaccucaccaugaacaacaagcacuggcugguacacaaagaaugguuccacgacauaccacuccccuggcacgccggugcagacaccggcacaccccacuggaauaauaaagaagcguuggucgaguucaaagaugcccacgcgaagagacaaaccguaguagugcucggcagccaagaaggagccguacacaccgcccucgccggcgcucucgaagccgaaauggacggagccaaaggucgccugagcuccggccaccuaaaaugccgacuaaaaauggacaaacuuagacuaaaaggaguaucauacucacucugcacggcagccuuuaccuucaccaaaaucccggcagaaaccuuacacggaacaguaacagucgaagugcaauacgcaggcacagacggccccugcaaaguccccgcacagauggccguagacaugcagacccucaccccggucggacgccucaucacagcuaacccggugaucaccgaauccaccgaaaacagcaaaaugaugcucgaacuugacccacccuucggcgacagcuacaucgucaucggagugggagaaaagaaaaucacgcaucacuggcaccguagcggaucaacgauaggaaaggccuucgaggccacgguaagaggcgcgaaaagaauggcaguccuaggagacacagccugggauuucgggucggucgguggcgcacucaacucacuaggcaaaggcauccaucaaaucuucggcgccgccuucaaaagccuauucggaggaaugagcugguuuagccaaauacuuauaggcacacuccuaauguggcucggacucaauacaaagaacggaagcaucucacuaaugugucuagcccuaggcgggguccucauauuccuauccacagucgucagcgccgacgucggcugcagcguugacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7277 - RNA, 2524 nt, Artificial Sequence
  KX811222.1 prME-long mRNA Design 2 opt
ggggcgcugccuacggagguggcagccaucuccuucucggcaucaagcuuaccaugagaaucaucaaugccagaaaagaaaagaaacggcgcggagccgacacauccgucgggauaguaggacuccugcucacaaccgcaauggcagcggaggucacucgacggggcucagcguacuacauguaccucgacagaaacgacgcaggagaagcaauaucauuccccacaacacuaggaaugaacaaaugcuauauccagauaauggaccuaggccacaugugcgacgcgacaaugagcuacgaguguccaaugcucgacgaaggaguagaacccgacgacguagacugcuggugcaacaccaccuccgcauggguaguguacggaacaugccaccacaagaaaggcgaagccagacgcucgcgcagagccgucacccuacccagccacuccacccgaaaacuucaaacccgcccacaaacauggcuagaaucacgggaauacaccaaacaccuaauacgcguugaaaauuggauauucagaaaccccggauucgcacuagcugccgcugccauagccuggcuacuagggaguucaacaucacaaaaagucaucuaccuagucaugaucuuacucaucgcacccgccuacagcauccgcuguauaggagucagcaaucgagacuuuguagagggaaugagcgggggcaccuggguagacgucguccuagaacacggcggaugcguaaccgucauggcgcaagacaaaccaaccgucgacaucgaacucgucacaacaaccgucucaaacauggccgaaguucgaucauacugcuacgaagcgaguauaucagacauggccagcgacucccggugccccacccaaggugaagcauaccuggacaaacaaagcgacacccaguacgucugcaaaaggacccugguggaccgcggauggggcaacggcugcggacucuucggcaaaggcagccucguuacgugcgcuaaauucgccugcagcaagaaaaugacaggcaaauccauccaacccgaaaaccuagaauaccgaaucaugcuaagcguacacggcucgcaacacucaggcaugauagucaacgacaccgggcacgaaaccgacgaaaaccgagccaaaguagaaaucacgccaaacucaccccgagccgaggccacacucggcggcuucggaucccucggccuagacugcgaacccagaacaggucucgacuucuccgaccuauacuaccugacaaugaauaauaaacacuggcucguccacaaagagugguuccacgauaucccacugcccuggcaugccggcgcggacaccggcacaccccacuggaacaacaaagaagcccuaguagaguucaaagacgcacacgccaaaaggcaaaccgucgucguccuaggaucccaagaaggcgccguccacaccgcccucgccggcgcccuagaagcagaaauggacggagccaaaggccgccucucaucaggccaccucaagugccgccuaaaaauggacaagcuacgacuaaaaggcgugagcuacucccucugcacagcggccuucaccuucacgaagauaccagccgaaacacuccacgggaccgucaccguagagguacaauacgcaggaacagacgggcccugcaaaguacccgcccaaauggccguagacaugcaaacccucaccccaguaggacgacucauaaccgccaacccagucauaaccgagagcaccgaaaacagcaaaaugaugcuagaacuagacccacccuucggcgauaguuacauuguaauaggcguaggcgaaaagaaaaucacacaccauuggcacagauccggaucaaccauuggcaaagcauucgaagcaaccguacgcggcgcuaaacgcauggccguacucggcgauaccgcaugggacuuuggauccgucgggggagcauuaaacucacuaggaaaaggcauccaccagauauucggcgccgcauucaaaucacucuucggaggaaugucaugguuuagccaaauacucauaggcacacuccucauguggcuaggccucaacaccaaaaacggaagcauaucccuuaugugccucgcccucggcgguguucucaucuuucuauccacagccgucagcgccgacgucggcugcucagucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7278 - RNA, 2524 nt, Artificial Sequence
  KX447516.1 prME-long mRNA Design 2 opt
ggggcgcugccuacggagguggcagccaucuccuucucggcaucaagcuuaccaugcgcaucaucaacgcccgcaaagaaaagaaacgacgcggcgcugacaccuccguaggcauaguaggacuccuacucaccaccgcaauggcagcagaagucacccgccgaggcagcgcauacuacauguaccucgacagaaacgacgccggugaagccauaucauuccccaccacccucggaaugaacaagugcuacauccaaauaauggaccuuggccacaugugcgacgccaccaugagcuacgaaugcccaaugcucgacgaaggaguagagccagacgacgucgacugcuggugcaacacgaccuccacuugggucgucuauggcacgugccaccacaagaaaggagaagccagaagaucacgccgugcaguaacgcuaccgagccacucaacccgaaaacuucaaacccguagccagaccuggcuagagucacgcgaauacacuaaacaccugauccgcguagaaaacuggauauuucgcaaccccggcuucgcgcucgcagccgcggcaauagccuggcugcuaggaucguccaccuccaaaaagguuauauaccucguaaugauccuccucauagcucccgcauacucaauaaggugcauaggcgucagcaaccgcgacuucgucgaaggcauguccggaggcaccuggguagacgugguccucgaacacggaggaugcgucacagugauggcacaagacaaacccaccgucgacauagaacucgucaccacuacagucagcaacauggccgaagucagaucauacugcuacgaagcaagcaucagcgacauggcauccgacucgcgcugccccacccaaggcgaagcauaccuagacaaacaaagcgacacccaguacguaugcaaacgcacacucgucgaccggggcugggggaacggcugcggucucuucggaaaaggcucccucguaaccugcgccaaauucgcaugcuccaagaaaaugaccggcaaaagcauccaacccgaaaaccucgaauaccgaaucaugcuaucgguccacgguucccaacacagcggaaugauagucaacgacaccggacacgaaaccgacgaaaaccgagccaaagucgaaauaacacccaacagcccgcgagcagaagccacacuaggcggauucggaagccucggccuagacugcgagccccgcacaggauuagacuuuuccgacuuauacuaccuaacgaugaacaacaaacacuggcucguccacaaagaaugguuccacgacauaccacuaccauggcacgcaggggccgacaccggaacaccacacuggaacaauaaagaggcacucguagaauuuaaagacgcacacgcaaaacgacagaccguugucguacucggaucccaggagggagccguccacaccgcacuagccggugcccuagaagcagaaauggacggagcaaaaggaagacuaaguagugggcaccucaaaugccgucuaaaaauggacaagcucaggcuaaaaggcgugagcuacucccucuguacagccgccuucaccuucaccaaaauccccgcugaaacacuacacggaaccgucaccgucgaaguccaauacgccggcaccgacggccccugcaaaguucccgcccagauggccgucgacaugcaaacccucacacccgucggucgacucaucacagcgaaccccgugauaaccgaaagcacugaaaauagcaaaaugaugcucgagcuggacccacccuuuggggacagcuacauaguaaucggcgucggcgaaaagaaaaucacccaccacuggcacagaagcgggagcaccauaggaaaagcauucgaagcaacaguccgcggugcaaaacguauggccguacucggagacacagccugggacuucggcagcguaggcggugcacuaaacagccuaggaaaaggaauacaccaaauauucggagccgccuucaaaagccucuucggaggcaugucgugguucucgcagauucucauaggcacacuucuaauguggcuaggccuaaacaccaagaacggcucaaucagccuaaugugccuggcacucggaggcguccuaaucuuccuaucaacagcagucagcgcagacgucggaugcagcguagacuuuuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7279 - RNA, 2524 nt, Artificial Sequence
  KX520666.1 prME-long mRNA Design 2 opt
ggggcgcugccuacggagguggcagccaucuccuucucggcaucaagcuuaccaugagaaucaucaacgcacgaaaagaaaagaaacgacgcggagccgacacauccguaggcaucguuggacuacuauuaaccacagcaauggccgccgaaguaacaagaagagguagcgcauacuacauguaucuugaccggaacgacgccggcgaagccaucagcuucccgaccacacuagggaugaacaaaugcuacauucaaauaauggaccugggccauaugugcgacgcaacaaugucauacgaaugcccgaugcucgacgagggcguagaaccggacgacgucgauugcuggugcaacacaacuucaacuugggucgucuacgguaccugccaccacaagaaaggcgaagcccgccgcucgcggcgcgcaguaacgcuacccagccacuccacgcgcaaacuacaaacccgcucccagaccuggcuagaaucgcgagaguacacaaaacaccuaauccgcguggaaaacuggauuuuccgaaacccaggcuucgcccucgcagccgcagcgaucgcauggcuccuaggcaguagcacacgacaaaaaguaauauaucuuguaaugauacuucucaucgcccccgccuacagcauccgaugcauuggcgucagcaacagggacuucguagaaggcauguccggaggaaccuggguagacgucguucucgaacacggcggcugcgucaccguaauggcacaagauaaaccgaccguagacaucgaacuugugaccaccacgguguccaacauggccgaaguaagaagcuacugcuaugaagcaagcaucagcgacauggccagcgacagcagaugccccacacaaggcgaggcuuaccucgauaaacaaucagacacccaguacguaugcaagcgaacccuagucgacagaggcuggggaaacggcugcggccucuucgguaaagggucacucguuaccugcgccaaauucgccugcagcaagaaaaugaccggcaagagcauccaacccgaaaaccucgaauaccgaaucaugcugucaguccacgguagccaacacucagguaugauagucaacgacaccggacacgaaacagacgaaaacagagcaaaagucgaaaucacacccaacagcccuagagcggaagccacccucggaggcuucggcagccuaggccuagacugugaaccacgcacaggccucgacuucagcgacuuauauuaucucacaaugaacaacaagcacuggcuaguccacaaagaaugguuccacgacauaccacuacccuggcacgcaggagcagacaccggcacaccccacuggaacaacaaagaggcacucguugaauuuaaagacgcacacgccaaacgacaaaccgucguaguacuaggaagccaagaaggcgcaguacacacagcccuagccggggcgcuagaagccgaaauggacggcgccaagggacgccucuccuccggacaccucaaaugucggcuaaaaauggacaaacuaagacuaaaagggguauccuacagccucugcacggcagccuucaccuuuaccaaaaucccagccgaaacccuacacgggacagucacaguagaaguucaauacgccgggaccgacggaccaugcaagguccccgcgcaaauggccguggacaugcaaacccuaacaccuguaggccgacucauaaccgccaaccccguaauaaccgaaagcaccgaaaacuccaaaaugaugcucgaauuagaucccccauucggcgacagcuacauaguaauaggcguaggcgagaaaaagaucacgcaccacuggcacagauccggcagcaccaucggaaaagccuucgaggcaaccgugcgaggcgccaaacgcauggccguccucggagacacggcaugggacuucggaucaguaggcggagcccuaaacagccuaggaaaaggaauacaccaaauauucggcgcagccuucaaauccuuauucggcggcaugagcugguucucacaaauacuaaucgggacccugcucauguggcucggacucaacaccaaaaacggaagcauaucccucaugugccucgcacucgggggcguacuaaucuuccugagcacagcaguauccgccgacguagguugcucggucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7280 - RNA, 2524 nt, Artificial Sequence
  KU729218.1 prME-long mRNA Design 2 opt
ggggcgcugccuacggagguggcagccaucuccuucucggcaucaagcuuaccaugcgcauaaucaacgcgcgaaaagaaaagaagcgaagaucggcagacaccagcgucggcauagucggccuacuccucaccaccgcgauggccgcagaagucacacgcaggggcuccgcauacuacauguaccucgaccgaaacgacgccggcgaagccaucaguuuccccacaacacuaggaaugaacaaaugcuacauacaaaucauggaccuggggcacaugugcgacgccacaauguccuacgaaugccccaugcuggacgaaggcguggaaccggacgacguagacuguuggugcaauaccaccagcaccuggguaguguauggcacaugccaccacaagaaaggagaagccagacgcucacggcgcgcagugacacucccaagccacagcacucguaaacuacaaacccgaagccaaaccuggcuagaaucccgagaauauacaaaacaccucauaagaguagaaaacuggauauuccgaaaccccggauucgcgcucgcagccgcagcaauagcauggcuacuuggcucaagcaccagccaaaaagucauauaccuagucaugauacugcucaucgccccagcauacucaaucagaugcauaggcguaagcaaccgagacuucguugaagggaugucuggagggacaugggucgacgucguacuagaacacggaggcugcgucacggucauggcccaggacaaaccaacgguagauauagagcucguaacgacaaccguaagcaacauggcagaaguacgcaguuacugcuacgaagccagcauaucagauauggccuccgacucccgcugccccacacagggagaggccuaccucgacaaacaaucagacacacaauacgucugcaaacggacgcuaguagaccgcggcuggggaaauggaugcggucucuucggcaaaggaucgcuagugacaugugccaaauucgcaugcuccaagaaaaugacaggcaaauccauccaaccagaaaaccuagaguacagaauaaugcucagcguacacggcagccaacacagcggcaugauagucaaugacacaggacacgaaaccgacgaaaaccgggccaagguagagauaacccccaacagcccaagagcagaggcgacccugggcgguuucggcagccucggccuagacugcgagccaagaacaggacucgacuucagcgaccucuacuaccuaacaaugaacaacaaacacuggcuaguacacaaagaaugguuccacgacauaccacuaccauggcacgccggcgcagacaccgggacaccacacuggaacaacaaggaagcccuagucgaguucaaggacgcacacgcaaaacgacagaccgucguaguacuaggaucacaagaaggggccguacacacagcccuagccggugcacuagaagcagaaauggacggagcaaaaggacgccuaucaagcggccaccuaaaaugccgccucaaaauggauaaacuucgucuaaaaggagucagcuacagcuuaugcacugcagcauucacauucacaaaaaucccagcagaaacacuacacggaaccgucacaguggaaguccaauacgccggaacagacggcccaugcaaaguaccagcccaaauggcggucgauacccagacacucaccccagucgggcgacucauaacagcaaacccagucaucaccgaaucgacagaaaacucaaaaaugaugcuagaacucgacccacccuucggcgacagcuauaucguaauagggguaggagagaaaaagauaacacaccacuggcaccggagcggcagcaccauaggcaaagcguucgaagccacaguccguggagcaaaaagaauggcaguauugggggauacggccugggacuucggcagcguaggaggagcccucaacagccuaggaaaagggauccaccaaauauucggcgccgcguucaaaagccuguucggaggaaugagcugguucucccaaauacuaaucgggacccuccucauguggcucggacuuaacaccaaaaacggaagcaucucacuaaugugccuagcacuaggaggagugcuaauuuuccugaguacagccguauccgcggacgucggcugcuccguugacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7281 - RNA, 2524 nt, Artificial Sequence
  KU761561.1 prME-long mRNA Design 2 opt
ggggcgcugccuacggagguggcagccaucuccuucucggcaucaagcuuaccaugagaaucaucaacgcaagaaaagaaaagaaaagacgaggagccgacacaaacguaggaaucgucggacuacuccucacaacugcaauggcagcagaagucacgcgacgaggauccgccuacuacauguaccuagaccgcaacgacgcgggcgaagcaauaucauucccaaccacccuggggaugaacaaaugcuacauacagauaauggaccucggacacaugugcgacgcgaccaugagcuacgagugcccaaugcucgacgaaggcguggaaccagacgaugucgacugcuggugcaacaccacgagcacaugggucguauacgggacaugccaccacaagaaaggagaagcgaggcgaucccggagagccgucacccucccgagccacucaacacgaaaacuacaaacaagaucgcaaaccuggcuagaaucgagagaauauaccaaacaccuaauaaggguagaaaacuggaucuuccgcaacccgggcuucgcgcuagccgcagccgcaauagccuggcugcuagggagcucaacaagccagaaaguaaucuaucuaguaaugauccuccuaauagccccagcauacagcauccgcugcauaggcguaagcaacagggauuucguagaaggaaugagcggaggcacauggguagacguagugcucgagcauggaggaugcgucacagucauggcacaagacaaaccaacagucgacauagaacugguaacaaccacaguguccaacauggcagaaguccgcagcuacugcuacgaagccagcauaagcgacauggcaagcgacagccggugcccaacacaaggagaagccuaccuagacaaacaauccgacacacaauacguuugcaaacgcacguuaguagaccgcggauggggaaacgguugcggacucuucggcaaagguagcuuggugacaugcgccaaauucgccugcaguaagaaaaugacaggcaaaagcauccaaccagagaaccuagaguacagaaucaugcucagcguccacggcucccaacacaguggaaugaucguaaacgacacaggacacgagacggacgaaaacagagcaaaaguagaaaucacacccaacagcccacgggcagaagccaccuugggaggauucggaucccuaggucucgacugcgaacccagaaccggauuagauuucuccgaccucuacuaccuaaccaugaacaacaaacacuggcucguccacaaagaaugguuccacgacaucccauuaccauggcacgccggugccgacacaggaaccccgcacuggaacaacaaagaagcccuaguggaguucaaagacgcccacgcaaaaagacaaacaguagugguucuaggaucccaagaaggugcaguccacacugcacuggcgggugcacucgaagccgagauggacggcgcaaaaggccggcuaucgagcggccaccuaaaaugcaggcucaagauggacaagcuaagacucaaaggcgugagcuacucacucugcaccgcagcguucacauucaccaaaaucccagccgaaacccuacacgggacagucacaguggagguccaguaugcaggcaccgauggcccaugcaaaguaccggcccaaauggcaguagacaugcagacacuaacaccggucggccgacuaauaacagcaaacccaguaaucacagaaagcaccgagaacucgaaaaugaugcuagaacucgaucccccauucggcgacagcuacaucguaaucgggguaggggagaagaaaaucacccaccauuggcaccggagcggcagcacgaucgggaaagcauucgaagccacgguacgaggagcgagacgaauggcaguccucggggacaccgcaugggacuucggcaguguuggcggagcauugaacucgcucgggaaagggauacaccagauuuucggggcagcauucaaaucacuauucggagggaugagcugguucagccagauccucaucggaacccuacugauguggcuuggacuaaacaccaaaaacggauccauaagccuaaugugccuagcccugggaggaguccuaauauuccuaaguacagccguaagugccgacguaggaugcagcgucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7282 - RNA, 2524 nt, Artificial Sequence
  KY317938.1 prME-long mRNA Design 2 opt
ggggcgcugccuacggagguggcagccaucuccuucucggcaucaagcuuaccaugcgaaucauaaacgcccgaaaagaaaagaaacgacgcggagcagaaaccucgguaggcauaguaggacugcuacuaaccacagcgauggcagccgaaguaacaagaagagguucagccuacuacauguaccucgaccgcaacgacgcaggcgaagcgaucagcuucccaacgacgcuaggaaugaacaaaugcuacauacaaauaauggaccugggccauaugugcgacgccacgaugaguuacgaaugccccauguuggacgagggagucgagccagacgacgucgacugcugguguaacacaacgagcacgugggucgucuacggaaccugccaccacaagaaaggcgaagcccgacgaucaagacgcgcaguaacacuaccgagccacuccacacgcaaacuccaaacaagaagccaaaccuggcucgaaagccgagaauacacaaaacaccuaauccgcguagaaaacuggaucuuccgcaacccaggcuucgcacuagcagccgccgcaauagcauggcuccucgguagcagcaccagccaaaaagucaucuaucuaguaaugauacuccuuauagcgccagcauacuccauucgaugcaucggcguuaguaaccgcgacuucguagaaggaaugucggguggaaccuggguagacgugguacucgagcacgguggcugcguaacggugauggcgcaagacaaacccacagucgacaucgaacucgugacaacaacaguaagcaacauggccgaaguccggucauacugcuacgaggcaucaaucagcgauauggccucagacagccgcugccccacgcagggcgaagccuaccucgacaaacaguccgacacacaauacgucugcaaacgaacgcuagucgacaggggaugggggaacggcugcggacucuucggcaaaggaucccuaguaaccugcgcaaaauucgccugcucaaagaaaaugacaggaaaaagcauucaaccagaaaaucuagaauacagaaucaugcugucaguucacggcucacaacacagcggcaugauaguaaacgacacaggccacgaaacagacgagaaccgagccaaaguagaaaucacucccaauagcccaagagcagaagcaacccuuggaggguucgggucacuuggacuagacugcgaaccacgaaccggccuagacuucagcgaccuuuacuaccucaccaugaacaauaaacacuggcucguacauaaagaaugguuccacgacaucccacugccguggcacgcaggcgccgacacagguacaccacacuggaacaacaaagaagcacugguagaguucaaagacgcccaugcgaaacgccagaccgucguugugcugggcucacaagaaggagccguacacacagcacuggccggagccuuagaagccgaaauggacggcgcgaaaggacgcuuguccuccggccaccucaaaugccggcuaaaaauggacaaacuacgccugaaaggaguuucguauucacugugcacagcagcguucaccuucaccaaaauaccagccgaaacccuacacggcacaguaaccgucgaaguacaauacgcgggaaccgacgggcccugcaaaguuccagcacaaauggcgguagacaugcaaaccuuaacaccgguaggcagacuaaucacagccaacccagucaucaccgaaaguacggaaaauucgaaaaugaugcuagaacuagacccgccauucggagacagcuacauaguaaucggggucggcgaaaagaaaauaacacaccacuggcacagaagcggcagcacgauaggcaaagccuucgaagccaccgucagaggcgcgaaacggauggcaguacuaggcgacaccgccugggacuucggcagcgucggcggagcccucaacagcuuaggcaagggaauccaccaaaucuucggcgccgcauucaagagccucuucggcggcaugucgugguucucccaaauccucauaggcacucuacuaauguggcuaggacucaacacgaaaaacggcagcauaagccugaugugccucgcguuaggcggaguccucauauuccugagcacagccgucucagcggacgucgggugcagcguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7283 - RNA, 2524 nt, Artificial Sequence
  KY075939.1 prME-long mRNA Design 2 opt
ggggcgcugccuacggagguggcagccaucuccuucucggcaucaagcuuaccaugagaauaaucaacgcccgcaaagagaaaaagcgcagaggcgcagacacauccguaggcauaguaggccuacuccugacaacagcaauggccgccgaaguaacccgucgaggaucagccuacuacauguaucuagaccgaaacgacgccggagaagcuaucagcuuccccaccacacucggcaugaauaaguguuacauccaaaucauggaccucggccacaugugcgacgcaaccaugagcuacgaaugcccaaugcuggacgaaggcguagaacccgacgacgucgacugcuggugcaacaccaccuccaccugggucgucuacggaaccugccaccauaagaaaggggaagccagacggagccgacgugcgguaacgcuccccagccacucaacucgcaaacuccaaacccgcagccaaacguggcucgaaagccgggaauacaccaaacaccuaaucagaguggaaaacuggauauuccgaaaccccggauucgcgcucgcagcagccgcgauagcuuggcugcucggaagcuccaccucccagaaaguaauauaucuagucaugauccuccucauagcacccgccuacagccuccgcugcauaggcguauccaaccgagacuucguggaaggcaugagcggcggcaccuggguagaugucguacucgaacacggaggcugcgucaccguaauggcccaagacaaacccacaguagacauagaacuugucacaaccaccguauccaacauggccgaagugcgguccuacugcuacgaagccagcauaucagacauggccucggacucacgaugcccaacccaaggcgaagccuaccucgacaaacaaagcgacacccaauacguaugcaaacgcacacucguagacagaggauggggcaacgggugcggucuuuucggaaaaggaucacucgucacaugcgcaaaauucgccugcuccaaaaagaugaccggaaaaucaauccaaccagaaaaccuagaauaccgcaucaugcucagcguacauggcucccaacacuccggcaugauagucaacgacaccggacacgaaaccgacgaaaaccgcgcaaaaguagaaaucacacccaacagcccacgagccgaagccacccugggaggguucgggagccuaggacucgacugcgaaccgcgaacgggacuagacuucuccgaccucuacuaccuuaccaugaacaacaaacacuggcucguccacaaagaaugguuccacgacaucccauuaccauggcacgccggcgcugauaccggcaccccacacuggaacaacaaagaagcccucgucgaguucaaagacgcucacgcgaaacgccaaaccguagucguacucggcucacaagaaggcgccgugcauaccgcacuagcaggggcacuagaagcagaaauggacggcgcaaaaggccgccucagcucuggccaccuuaaaugcagacuaaaaauggacaagcuacgccuaaagggcgugagcuacucacugugcaccgcagccuuuaccuucaccaaaauccccgccgaaacucuccauggaaccguaacagucgaaguccaguacgccggcacggacggaccaugcaaaguccccgcacaaauggccguugauaugcaaacacugacacccgugggaagacucaucaccgccaacccagucaucaccgaaagcacagaaaacucaaaaaugaugcuggaauuagacccaccauucggcgacucauacaucgugaucggggucggagaaaagaaaauaacacaccacuggcaccgcagcggaucaacaauaggcaaagcauucgaagccacagucagaggggcaaaaagaauggcgguacuaggagacacagcaugggacuucggcucagugggcggagcccucaacucccuuggaaaaggcauucaccaaaucuucggggcagcauucaaaucccuauucggaggaauguccugguucucgcaaauacucaucggcacgcuccuaauguggcuaggacuaaacaccaaaaacggaaguauaucccuaaugugccucgcgcucggaggcguacuaauuuuccugagcaccgcagucagcgcagauguaggcugcuccgucgacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7284 - RNA, 2524 nt, Artificial Sequence
  KX806557.2 prME-long mRNA Design 2 opt
ggggcgcugccuacggagguggcagccaucuccuucucggcaucaagcuuaccaugcgcauaaucaaugcacgaaaggagaaaaagcgcaggggagccgacaccaacguaggcauagucggccuacuucuaacaacagcaauggcggccgaaguaacaagacgcggaucagccuacuacauguaccucgaccgaaacgacgccggcgaagccaucagcuuccccaccacccucggcaugaacaaaugcuacauacagauaauggaccucggucacaugugcgacgccacaaugucauacgaaugccccaugcuagacgagggaguggaaccggacgacgucgacugcuggugcaacaccaccagcaccuggguagucuacggaaccugccaucacaagaaaggcgaagccagaagaucccgacgcgcuguaacccuccccagccacagcacucgcaaacuccaaaccaggucacaaaccuggcuagaaucucgagaguacacaaaacacuuaauacgaguagaaaauuggauguuccgaaaccccggauucgcccucgcggcagcagcaauagccuggcuccucggauccuccacaucgcaaaaagucauauaccuuguuaugauccuacuaaucgcaccggcauacagcauccgcugcaucggagucucaaacagagacuucgucgaaggaaugucgggcggcacaugggucgacgucguucuugagcacggaggaugcgucacggucauggcucaagacaaaccuacaguagacauagagcugguuacaacaaccguguccaacauggccgagguccgguccuacugcuacgaggcauccaucagcgacauggccuccgacucacgaugcccaacccaaggggaggcuuaccucgacaaacaaagcgacacacaauacgucugcaaacgaacacugguugauaggggauggggcaacggcugcggccuuuuuggcaaaggaagccuggucacaugcgccaaguucgccugcagcaagaaaaugacgggcaaaaguauacaaccagaaaaccuggaauaccgaaucaugcucagcguccacgguucccaacacuccggcaugauaguaaacgacacaggccacgaaacagacgaaaacagagcaaaagucgaaaucacccccaacagcccacgggccgaagccacacugggcgguuucggcagccucggacucgacugcgaaccgcgcacgggacucgacuucucagaccucuacuacuuaacaaugaacaacaaacacuggcucguccacaaagaaugguuccacgacauuccccuaccauggcaugccggagcggacaccggcacaccccacuggaacaacaaagaagcacuggucgaguucaaagacgcacacgccaaacggcaaacagucgucguccuaggaucacaagaaggagcaguccacacggcacuagcgggcgcccuagaagccgaaauggauggcgcaaaaggccggcuaucaagcggacaccuaaaaugcagacuaaaaauggacaaacuuagacucaaaggcguaagcuacagcuuaugcacagccgccuucaccuucacgaaaauccccgcagaaacacuccaugguacagucacgguagaagugcaauacgccggcacagacgggccaugcaaagucccugcacaaauggcagucgacaugcagacccuaaccccagucggccgacucauaacggccaauccagucaucacagagucaaccgagaacagcaaaaugaugcucgagcucgacccgccauucggcgacagcuauaucgucaucggugucggcgaaaagaaaaucacacaccauuggcacaggagcgguagcacaauaggcaaggcauucgaagcaaccguccgcggcgccaaacgcauggccguccuaggagacaccgccugggacuucggaucaguagggggcgcccucaauagccugggcaaaggcauccaucaaaucuucggggcagccuucaaaagccuuuucgguggaauguccugguucagccaaauccucauaggcacccuccuaauguggcucggccucaacacgaaaaacggguccauaucccucaugugucuagcacuaggcggaguccucaucuuccucuccaccgcggucucggccgacgucggaugcucgguagauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7285 - RNA, 2524 nt, Artificial Sequence
  KU870645.1 prME-long mRNA Design 2 opt
ggggcgcugccuacggagguggcagccaucuccuucucggcaucaagcuuaccaugagaauaaucaacgcccgaaaagagaaaaagcgccgaggcgccgacacaagcgucggcaucgucggacuucuccuaacaacagccauggccgcggaaguaacaagaaggggcagugcauacuacauguaccucgaccgcaacgacgcaggagaagccaucagcuuccccacaacauuaggcaugaauaaaugcuacauacagaucauggacuugggccacaugugcgacgccacaaugagcuacgaaugccccaugcucgacgaaggcguagaaccagacgacgucgacugcuggugcaacacaacaagcacgugggugguauacggaaccugccaccacaagaaaggagaagcaagacgaagccguagagcagugacacuccccagccacucgaccagaaaacugcaaacacgcagccaaaccuggcucgaaucacgagaauacaccaaacaccucauccgagucgaaaacuggauacuacggaaccccggauuugcacucgcagcagccgccaucgcauggcuacucggcucaucgaccucccagaaagucauauaccuuguaaugauacuccuaaucgcgcccgccuacagcauccgaugcaucggcgugucuaaucgagacuucguagaaggcaugagcggaggcacaugggucgacgucguacuggagcacggaggcugcgugacgguaauggcacaggacaaacccacagucgacauagagcuagucacaacgaccgucuccaacauggcagaaguacgcagcuacuguuacgaagccagcauaagcgacauggccagugacagccggugcccaacccaaggggaagccuaccuagacaaacaaagcgacacacaauacguaugcaaaagaacccucgucgaucgaggcuggggaaacggaugcggccucuucgggaaaggaucccucgugaccugcgccaaauucgcaugcagcaagaaaaugaccggaaaaaguauacaaccagaaaaccuagaguaucgcauaaugcuaucaguccacggcucccaacacuccgggaugauagucaacgacaccggccacgaaacagacgaaaaucgcgcaaaagucgaaaucaccccaaacagcccaagagcugaagccacccuaggaggauucggaucccucggccucgacugcgaaccacgaacaggccucgacuuuuccgacuuauauuaccucacaaugaacaacaaacacuggcuaguccacaaggaaugguuccacgacaucccacuacccuggcacgcaggcgcagacacaggcaccccacauuggaacaacaaagaagcacucguggaguucaaagacgcucacgcaaaacgccaaacaguaguaguccuaggcucacaagaaggugccguccacacagcucucgccggagcccuagaagcagaaauggauggagcaaaaggccgccugucgagcggccaccucaaaugucgacuaaaaauggacaaacuacgccuaaaaggcgucagcuacagcuuaugcacagcagccuucaccuucacaaaaauaccggcggaaacacuccacggcacggucacgguugaaguccaauacgccggcacagacggucccugcaaagucccagcacaaauggcagucgacaugcaaacccuaaccccaguagggcgucuuaucacagccaacccagucauuaccgagucaacagaaaacaguaaaaugaugcuagaacucgacccacccuuuggggacucguacaucgucaucggaauaggagaaaagaaaauaacccaccacuggcaccgaagcggcuccaccauaggcaaagccuucgaagcaacaguaagaggagcaaaacgcauggcaguacuuggagacaccgcgugggacuucggaagcgucggaggcgcgcucaacagccucggcaaaggcauccaccagaucuucggcgccgcguucaaaagccuguucggaggaaugucaugguucucccagauacuaaucggaacccuccuaauguggcuagggcugaacacgaaaaacggaucgauaagccuaaugugucucgcccuaggaggcguacuaauauuccucuccacagcaguaagcgcagacgucggcugcuccguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7286 - RNA, 2524 nt, Artificial Sequence
  KU729217.2 prME-long mRNA Design 2 opt
ggggcgcugccuacggagguggcagccaucuccuucucggcaucaagcuuaccaugaggauaauaaacgcacgaaaagagaaaaagcgaagaggagccgacacauccgucggaaucgucggacugcuauuaacaacagccauggccgcagaagucacccgcagaggcuccgccuacuacauguaccuagaccgaaacgacgcgggugaagcaaucuccuuccccaccacacucgguaugaacaaaugcuacauacagaucauggaccucggccacaugugcgacgcaacgauguccuacgaaugcccaaugcuagacgaaggcguagaacccgacgacgucgacugcuggugcaacacaaccaguacaugggucguauacgggaccugccaccacaagaaaggagaagcccgaagaucccggcgggcaguaacccuaccgucacacuccacacgcaaacuucaaacgcgaagccaaaccuggcuagagaguagggaauauacaaaacaccuaauaagaguagagaacuggauauuccgcaaccccggauucgcgcucgcggccgccgcaauagcauggcuacucggcagcagcaccagccagaaaguaauauaccuagucaugauccuacucauagccccggcuuacucaauccgcugcauaggggucagcaaccgcgacuucguagaaggcaugagcggaggaacauggguggauguaguacuagagcacggcgggugcguaaccguaauggcacaagacaaaccuaccgucgacaucgaacucguaagcacaacuguauccaacauggccgaaguaaggucuuacugcuacgaagccaccauauccgacaucgccuccgacuccagaugcccaacgcaaggggaagccuaccuagacaaacaauccgacacacaauauguaugcaaacgaacccuagucgacagaggauggggaaacggcugcggacuauucggcaaaggaagucugguaaccugcgcaaaauucgcaugcuccaagaaaaugacaggaaaauccauacaacccgaaaaccucgaauaccgcaucaugcuaagcguccacggaagccaacacagcggaaugaucgucaacgacaccggacacgaaaccgacgaaaaccgagccaaaguagaaaucacaccaaacagcccccgcgccgaagccacccucggcggcuucggcucccuaggacuggacugcgaaccacgaaccggccuagacuucagcgaccuauacuaccuaaccaugaacaacaaacacuggcuaguccacaaagagugguuccacgacaucccauugcccuggcacgccggagccgacaccgguacaccccacuggaacaacaaagaagcccuaguagaauuuaaagacgcccacgcuaaaagacaaaccgcagucguccucggaucccaagaaggcgccguacacacagcacuagcaggcgcgcucgaagccgaaauggauggcgcgaaaggaagacucagcagcgggcaccucaaaugccgguuaaaaauggacaaacuccgccucaaaggcgucucauacagccucugcaccgcagcuuucaccuucacuaaaauccccgcggaaacucuacacgggacagugaccgucgaaguccaauacgccggaacagacggcccaugcaagguaccagcacaaauggcagucgacaugcaaacccuaaccccgguaggaagauuaauaacggccaacccuguaauaaccgaaagcaccgaaaacagcaagaugaugcucgaacucgaucccccuuuuggcgacagcuacaucguaaucggcgucggcgaaaagaaaaucacccaccacuggcaccgauccggauccacaaucggcaaagccuucgaagcaacgguccggggagccaaacgaauggcgguccugggagacacggcaugggacuucggauccguagguggggcccuaaacucguuaggcaaaggcauccaccagaucuucggcgcagccuucaaaucacucuucgggggaaugagcugguucucgcaaaucuuaaucggaacacuucuaauguggcucggccuuaacaccaaaaacggaagcaucucgcugaugugccuagcacuaggcggaguccucauauuccuaagcacagccguauccgcagacgugggcugcagcguugacuuuagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7287 - RNA, 2524 nt, Artificial Sequence
  KU497555.1 prME-long mRNA Design 2 opt
ggggcgcugccuacggagguggcagccaucuccuucucggcaucaagcuuaccaugagaaucauaaacgcacgcaaggaaaagaaacggcgcggcgccgacacauccguaggcaucgucggcuuacuccuaacaacagcaauggcagccgaaguaacaaggcgaggaagugccuacuacauguaccuggacaggaacgacgcaggagaagccaucagcuucccaaccacucucggcaugaacaaaugcuauauacaaaucauggaccuaggacauaugugcgacgcaaccaugagcuacgaaugccccaugcuagacgaaggaguggaaccagacgauguagacugcuggugcaacacaaccucaacaugggucguauacggaaccugccaccacaagaaaggugaagcccgacgcucaagacgagcgguaacacucccuagccacucuacccgaaaacuccaaacccgcagccaaacauggcucgaaucccgagaguacacaaaacaccuaauacgaguagaaaacuggauauuccgaaacccgggauucgcccuagccgcagccgcaaucgccuggcuccuaggcagcagcaccucgcaaaaagucaucuaccuagucaugauacuacucauagcccccgccuacagcauccgcugcauaggaguaucgaaccgggacuucguagagggcaugagcggcggcaccugggucgacguaguacuagaacacggcgggugcguuacggucauggcacaagacaaacccacggucgacaucgagcuagucacgaccaccgucucaaacauggcagaaguccgcuccuacuguuacgaagcaucaaucagcgacauggcguccgacuccaggugcccgacccaaggagaagccuaucucgacaagcaaagcgacacacaguauguuugcaagcgcacccuugucgacaggggcugggguaacggcugcggccucuucgggaagggcucccuagucacaugugcaaaauucgcaugcagcaagaaaaugaccggcaaauccauccaaccagaaaaccucgaauaccgcauaauguuaagcguacacggcucccaacauuccggcaugaucguuaacgacaccggacacgaaacagacgaaaaccgagcaaaagucgaaauaacaccaaacagcccccgagcagaagccacccuaggaggauucggaucacucggacuagacugcgaaccgcgaaccggacucgacuucucagaccuuuacuaccuaacaaugaacaacaaacacuggcucguacacaaagaaugguuccacgacauaccacugcccuggcacgccggcgcagacacaggaacgccacacuggaacaacaaagaagcccuagucgaguucaaagacgcacacgccaagcgacaaacagugguaguacucggaacccaagaaggggccguccacaccgcccuggcaggagcacucgaagccgaaauggacggggcgaagggacgccucuccucaggacacuuaaaaugcagacuuaagauggacaaacuccgacuaaaaggagucagcuacagccuaugcaccgcagcauucacguucaccaaaauaccagcugaaacacuccacggcacggucacagucgaaguccaauacgccggcacagacggaccaugcaaaguacccgcccagauggccguggacaugcaaacgcucacccccgucggacgccucauaaccgccaaccccgucauaaccgaauccaccgaaaacagcaaaaugaugcuagaacucgacccucccuucggagacucauacaucgucauaggcgucggcgaaaagaaaaucacgcaccauuggcacagauccggaucaacaauaggcaaagcauucgaagcaacagugagaggggccaagcgaauggcaguccuuggagacacagcaugggacuucggaagcguagguggugcgcuaaacucccuaggcaaaggaauccaccaaaucuucggagcagcauucaaaagccuuuuuggcggaaugucgugguucagccaaauccuaaucgggacgcugcuaauguggcuaggacuaaacacgaaaaacggauccaucucgcugaugugccuagcacuaggcggaguccugaucuuccuuucaaccgccgucuccgcagacguaggcugcucagucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7288 - RNA, 2524 nt, Artificial Sequence
  KX087101.3 prME-long mRNA Design 2 opt
ggggcgcugccuacggagguggcagccaucuccuucucggcaucaagcuuaccaugcgaauaaucaacgcccgaaaagaaaagaaaagacgaggggcagacacauccgucggcauaguagggcuccuccucacaacagccauggccgcagaaguaacccgacgaggcagcgcauacuauauguaccucgacaggaacgacgccggugaggcaauaucguuccccacgacccucgggaugaacaagugcuauauacagaucauggaccucggccacaugugcgacgcaacaaugucauacgaauguccaaugcucgacgagggaguagaacccgaugacguugacugcugguguaacaccaccagcacguggguugucuacggaaccugccaucacaagaaaggcgaagcccgacgcucccgcagagccgucacacugcccucgcauucaacaagaaaacuccaaacacgcucccaaacauggcucgaaucccgcgaauauacaaaacaccucauccgcguagaaaacuggauauucaggaaucccggguucgcccuagccgccgcagcaaucgccugguugcucggcucaagcaccagccaaaaaguaauauacuuagucaugauccuacucaucgcccccgcguacagcauccgcugcaucggagucaguaaccgggacuucgucgaaggcauguccggaggaacauggguggacgucguacuagagcacggaggcugcgugaccguaauggcacaagacaaacccacaguagauauagagcuaguaacgacaaccguauccaacauggcagaaguucgaagcuacugcuaugaagcaagcaucagcgacauggcaagcgacucccgaugccccacccagggagaagccuaccuagacaagcaauccgacacacaauacguaugcaaacgaacccucgucgaccgcggauggggaaacggcugcggccuauucgggaaaggaucccuaguaacaugcgcaaaauucgcaugcagcaagaaaaugaccgguaagagcauccaacccgaaaaccucgaauaccgaauaaugcucaguguacacggcucccaacacagcggcaugaucguaaacgacacaggacacgaaaccgacgaaaaccgugcgaaaguggaaauaaccccgaacucccccagagccgaagcaacccuaggcggcuucggaucacugggccucgacugcgaaccaagaaccggacuagacuucuccgaccuauacuaccucacaaugaacaacaaacacuggcucguacacaaggaaugguuccacgacauaccccuccccuggcacgccggagcagacacagggacaccgcacuggaacaauaaagaagcccuggucgaguucaaagacgcucacgcaaaacgccaaacugucgucguccuuggcagccaagaaggcgccguccacacagcacucgccggugcccucgaagccgaaauggacggagccaaagggcggcuaagcagcgggcaccugaaaugccggcuuaaaauggacaaacuccgacugaaagguguaucauacagccuaugcaccgcagccuucacauucacaaaaauacccgcagaaacacuccacggaaccgucacagucgaacuccaauacgccggaaccgacggacccugcaaagugccagcccaaauggcaguagacaugcaaacgcucacucccguaggccgccuuauaacugcgaaccccgucauaaccgaaagcacagaaaacagcaaaaugaugcucgaacucgaucccccguuuggggacucauacaucgucauuggcgugggcgaaaagaaaaucacgcaccacuggcaccgcucaggcagcacuaucggaaaagcauucgaagcaaccguccgcggcgccaagagaauggcuguacucggcgacaccgcaugggacuucggaucggucggaggggcccucaacagccucggcaaaggaauacaccaaaucuucggcgccgccuucaaaucucuauucggagggaugucgugguuuucccagauccugauaggcacccuccucauguggcuaggccucaacacgaaaaacggcuccauuagccuuaugugccucgcccuaggcggcguauuaaucuuccucucaacagcagucagcgccgacguagggugcagcgucgacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7289 - RNA, 2524 nt, Artificial Sequence
  KY075932.1 prME-long mRNA Design 2 opt
ggggcgcugccuacggagguggcagccaucuccuucucggcaucaagcuuaccaugcggaucaucaacgcccgcaaagaaaagaagcgcagaggagcagaaaccuccgucggcauagucggccugcuacuaaccaccgccauggccgccgaagucaccagacgaggcuccgccuacuacauguaccucgacagaaacgacgccggcgaagccaucuccuucccuacaacccucggcaugaacaaaugcuacauacaaauaauggaccuaggccacaugugcgacgccacuaugagcuacgaaugccccaugcucgacgaaggagucgaacccgacgacguggauugcuggugcaacaccacaucgacaugggucguguacgggacgugccaccacaaaaagggagaagccagacgaucacgcagagccgucacacuccccagccacagcacgagaaaacuacaaacacguagccaaacguggcucgaaagccgcgaauacaccaagcaccucauccgcaucgagaacuggauauuccgcaaccccggcuucgcacuagccgcggccgccaucgcauggcuacucggaucgagcaccucacaaaaagucauauaccuagucaugauccuacuaauagcccccgcauacuccauacgcugcauuggcgucagcaaccgggacuucguagaaggcaugagcgguggcacaugggucgacgucguccucgaacacggaggcugcguaaccgucauggcucaagacaaaccuacgguagacauagaacugguuaccacaacagucagcaacauggccgaaguccgcagcuauugcuacgaagcaagcauaucagacauggccagcgacucccguugcccaacacagggagaggcauaccuagacaaacaauccgauacacaguacguaugcaaacguacccucgucgaccgcgguuggggcaauggcugcggccuauucggaaaaggaagccucgucacaugugcaaaauucgccugcaguaagaagaugacaggcaaaucaauccaacccgaaaaccuagaauacagaauaaugcucucgguccacggaagccaacacuccggaaugaucguaaacgacaccggacacgaaaccgacgagaaccgcgccaaggucgaaaucacccccaacucaccacgcgcggaagcaacacugggaggcuucggaucacucggacucgacugcgaaccccgaaccggauuagacuuuuccgaccucuacuaccucacaaugaacaauaaacacuggcucguccacaaggaaugguuccaugacauaccacuacccuggcaugccggcgcggauacgggaacgccccacuggaacaauaaggaggcccucguggaguucaaagacgcccacgcaaaacgccaaaccguaguagugcucggcagccaagaaggagcuguccacaccgcccuggccggagcccucgaagccgaaauggacggggcgaaaggacgccucuccucgggccaccugaaaugccgccuaaaaauggacaaacuccgauuaaaaggggucaguuacagccuaugcaccgcggcauucaccuucacaaaaauaccagcagaaacacuacauggaaccgucacagucgaaguccaguacgccggcacagacgguccauguaaaguccccgcacaaauggccgucgacaugcaaacacugacuccagucggaagacucaucaccgcaaacccaguaauaaccgaaucaaccgaaaacuccaaaaugaugcucgaacucgacccaccauucggcgacuccuacauaguaauaggcgucggagaaaagaaaauaacacaccacuggcaccgaagcggauccaccauuggcaaggcuuuugaagcaaccguacgaggagccaaacgcauggccgugcuaggagacaccgccugggacuucggcuccgucggcggcgcccuaaacucccugggcaaaggcauacaucaaauauucggcgccgcauucaaaucacucuucggaggcaugagcugguucagccagauccucauaggcacccuccuuaugugguugggccucaacaccaagaacggaagcaucucccucaugugccuagcacucggcggcguacucauauuccucucaacagccgucagcgccgacguaggcugcagcgucgacuucucuaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7290 - RNA, 2524 nt, Artificial Sequence
  KY014317.1 prME-long mRNA Design 2 opt
ggggcgcugccuacggagguggcagccaucuccuucucggcaucaagcuuaccaugagaauaauaaacgcacgaaaggaaaagaaacgccgaggcgcggacacaagcgugggaauagucggacuccuacucacaacggcaauggcagccgaagucacacgaaggggcucagcuuacuacauguaccuggacagaaacgacgccggggaagcaaucagcuuuccgaccacacuaggaaugaauaaaugcuacauacaaauaauggaccucggacacaugugcgaugcaaccaugucguacgaaugcccaaugcuugacgagggcguagagcccgacgacgucgauugcugguguaacaccacgagcacauggguaguuuauggaacaugccaccacaagaaaggagaagcacgcagaagcagacgcgcugucacgcucccaagucacagcacgcgcaagcuccagacccggagccagaccugguuagaaagccgcgaauacaccaaacaccucaucagagucgaaaacuggaucuucagaaacccaggguucgcacuagcagccgccgccauagccuggcuacucggauccuccacgagccagaaaguaauauaccucguaaugauacuccugaucgcaccagcauacucgauccgcugcauaggcguaagcaaccgggacuucguggaagggaugucaggaggaaccugggucgauguaguucuugagcacggaggaugugugacgguaauggcucaggacaaacccacgguagacauugaacucgucaccaccaccgugagcaacauggcagaagugcgaucauacugcuacgaggccuccauauccgacauggccagugacucaagaugcccaacgcaaggagaagcguaccuagacaaacaaucagacacgcaguacgucugcaaacgaacgcuagucgaccgcggaugggggaacgggugcggacuauuuggcaaaggcucacuggugacaugcgccaaauuugcaugcucaaagaaaaugacaggcaaauccauacaacccgagaaccucgaauaucggaucaugcuauccguacauggcucacaacauagcggcaugauagucaacgacacaggacacgaaacagacgagaacagagccaaagucgaaauaaccccaaauagcccccgcgcggaagcaacccucggaggauucggaagccuaggacuggacugugaaccaagaacaggcuuggacuuuagcgaccucuacuaccugacaaugaacaacaaacacuggcuaguccacaaagaaugguuccacgacauaccgcuaccguggcacgcaggggccgacaccggcaccccgcauuggaacaacaaagaggccuuagucgaguucaaagacgcacacgcaaaaagacaaacgguaguaguacucggcucgcaagaaggcgccguacacaccgcgcucgcaggagcccucgaagcggaaauggacggagcaaaaggucgccugagcuccggccaucucaaaugcagacuaaaaauggacaaacugagacucaaagggguaucuuacagccuaugcacggcagccuucacauucacaaaaaucccugccgagacacuacacgggacggucacagucgagguacaauacgccggaaccgacggaccaugcaagguacccgcccaaauggccgucgacaugcaaacacuaacaccagucgggcgccuaaucacagcuaaucccgucaucacugaaucaaucgaaaacagcaaaaugaugcuagaacuagauccgcccuucggcgacagcuacaucguaaucggcgucggagaaaagaaaaucacacaccacuggcauagaagcgggagcacaauaggcaaagcauucgaagccacaguacgcggagcgaaacgaauggcaguccucggcgacaccgcgugggauuucgggagcgucggcggcgcacucaacucgcucggaaaaggaauccaccaaaucuucggagccgcauucaaaagccuauuuggcggcaugagcugguuuagccaaauacucaucggaacacuccugauguggcucggacucaacacgaaaaacggcagcauaaguuugaugugccucgcccucggagggguacucauauuucugagcacagccgucagcgcagacguagggugcagcguggacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7291 - RNA, 2524 nt, Artificial Sequence
  KU758876.1 prME-long mRNA Design 2 opt
ggggcgcugccuacggagguggcagccaucuccuucucggcaucaagcuuaccaugcgcaucauaaacgcccgcaaagaaaagaaacgcagaggcgcagacacaucagucggcaucguaggacuucuacuaacuaccgcgauggcagcagagguaacccgccgcggauccgcauauuacauguaccucgaccgcaacgacgcgggcgaagcaaucucauucccaacaacccugggaaugaacaaauguuacauccaaaucauggaccucggacacaugugcgacgcaaccauguccuacgaaugccccaugcuagacgaaggcgucgaaccagacgacgucgacugcuggugcaacaccaccagcacauggguuguauacggcacgugucaucacaagaaaggagaagcgcgccgaagccgacgcgcagugacgcugcccucccacuccacccgcaaacugcaaacgcgcucccagacauggcuagagagccgagaguacaccaaacaccuaauccgaguagaaaacuggaucuuccgcaacccaggcuucgcacucgccgccgccgcaaucgccuggcuacucggaucuagcaccagccaaaaaguaaucuaccucgucaugauccuccugaucgcucccgccuacagcauccggugcaucggggucagcaacagagacuucguagaaggaauguccgggggaacauggguagacgucguccuagaacacgggggcugcguaacugucauggcucaggacaaacccacagucgacauagaacuugucaccaccaccgucagcaauauggcggaaguacgcagcuacuguuacgaagcaagcauaucagacauggccucugacagccguugcccgacccaaggagaagcauaucucgacaaacaguccgacacccaauacgucugcaaacgaacccucguagaccgaggaugggggaacggauguggacucuucggcaaaggaagccucguaaccugcgcaaaauucgcauguuccaagaaaaugaccggcaaaucaauccaaccagaaaaccucgaauaccgaaucaugcucagcguccacggaucccagcacuccggcaugaucguaaacgauacuggccacgaaaccgacgaaaaccgagccaaagucgaaauaacccccaauagcccacgcgccgaagccacccuaggcggauucggcucccucggccucgacugcgaaccacgcaccggccuagacuucagcgaccucuauuaccuaaccaugaacaacaaacacuggcugguccacaaagaaugguuccacgacaucccccucccuuggcacgccggggcggacacaggaaccccacacuggaacaauaaagaagcacucgucgaguucaaagacgcacacgcuaaaaggcaaaccgucguaguacuaggcagccaagaaggagcaguucacaccgcauuagccggcgcacuagaagccgaaauggacggagucaaaggacgccucuccuccggacaccuaaaaugccgccucaaaauggacaaacuacgccuaaaaggaguaaguuauucacucugcacagcagccuucacauucaccaaaaucccagcagaaacccuacacggcacagugacaguggaaguccaauacgcaggcaccgacggcccaugcaaagucccugcacagauggccgucgacaugcaaacccucacaccagucggcaggcucaucaccgcuaacccaguaaucaccgaaucaaccgaaaacucaaagaugaugcucgaacucgacccgcccuuuggggacuccuacaucgugaucgggguuggggaaaagaaaaucacccaccacuggcaccguucaggaucaacaaucggcaaagcauucgaagcaaccguacgaggcgcaaaaagaauggccguacuaggcgacacagcaugggacuucggcucagucggcggggcccuaaacucccucggcaaaggcauacaccaaaucuucggagcagcauucaagucccucuucggcggcaugagcugguucagccaaauccucaucggcacacugcuaauguggcugggacucaacaccaaaaacggaucgaucucauucaugugccuggcacucgguggcgugcucauauuccucagcacagccgucuccgcagacgucggcugcagcguagauuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7292 - RNA, 2524 nt, Artificial Sequence
  KU758874.1 prME-long mRNA Design 2 opt
ggggcgcugccuacggagguggcagccaucuccuucucggcaucaagcuuaccaugaggauaauaaacgcccgaaaggaaaagaaacgacgaggagccgacacauccgucggcaucguaggacuccuccuuaccaccgccauggcggcggaggucacacgcagagggucagccuacuacauguaccuagaccgcaacgacgccggcgaagcgaucaguuuucccaccacgcugggaaugaacaaaugcuacauccaaaucauggaccuaggacacaugugcgacgccacaaugucauacgaaugccccaugcucgacgaaggcgucgaaccagacgacgucgacugcuggugcaacacgaccuccacaugggucguguacggaaccugucaccacaagaaaggcgaagcccgacgaucacgcagagccgucacccuacccucccacagcacccgcaaacuucaaaccagaucacaaaccuggcucgaaucccgagaguauacaaaacaccucauacgagucgaaaacuggaucuuccgcaacccaggauuugcccuggcggccgcugccauagccuggcuacucggcuccucaaccucacaaaaggucauauaccucgucaugauccuccuaaucgcccccgccuacagcauccgcuguauaggagucucaaacagagacuuuguagaaggaaugucaggcgggaccuggguugacgugguacuggaacacggcggcugcguaacugucauggcgcaagacaaacccacaguggacauagagcuaguaaccaccaccguaagcaacauggcagaaguacgcuccuacugcuacgaagcaucgaucuccgacauggccucagacucccgcugccccacccaaggcgaagcauaccucgacaaacaaucagacacccaauacgucugcaagcgcacccucguagaccgcggauggggcaacggcugcggccuguucgggaaaggcucccuaguaaccugcgccaaauucgcaugcagcaaaaagaugacuggcaaauccauccaacccgagaaccucgaauacagaaucaugcucucaguccacggaucccaacacuccggcaugauagucaaugacacgggacacgaaacagacgaaaaccgcgcgaaagucgagaucaccccaaacucaccccgagcagaagcaacccuuggaggauucggcagccuaggacucgacugcgaacccagaaccggccuagacuucuccgaccucuacuaucucaccaugaacaacaaacacugguuaguccauaaggaaugguuccacgacaucccccuccccuggcacgcaggcgcugacaccggcacaccccacuggaacaacaaagaggcacucgucgaguucaaggacgcccacgcaaaacgacaaacaguagucguacucggcucccaggaaggcgcaguacacacagcccuagcaggcgcacucgaagcggaaauggacggagcaaaagguaaacuuucaagcggccaccucaaaugccgacugaaaauggacaagcugcgccuaaaaggagucagcuacagucucugcacggccgcauucacauuuacaaaaauaccagccgaaacgcuacacggcaccgucaccgucgaaguccaauacgccggcaccgacggccccugcaaaguacccgcacaaauggccguagacaugcaaacccucacaccgguaggacgccucaucaccgcaaaccccgucauuacagaauccaccgaaaacucaaaaaugaugcucgaacuagaucccccguuuggugacuccuacaucgucaucggaguaggagaaaagaaaauaacacaccacuggcaccgcagcggaucgacaaucggaaaagccuucgaggcaaccgugcgcggcgcaaaacgaauggccguccucggagacaccgccugggacuucggcuccgucggcggggcacuaaacagccuaggaaaaggaauccaucagauauucggagcagccuucaaaucacuguucggaggcauguccugguucucccaaauacugauaggcacacuacucaugugguuaggccucaacaccaaaaacggaagcauaagccucaugugccucgcccucggcggcguccucauauuccucuccacagcggucuccgcagacgugggaugcagcguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7293 - RNA, 2524 nt, Artificial Sequence
  KY014314.1 prME-long mRNA Design 2 opt
ggggcgcugccuacggagguggcagccaucuccuucucggcaucaagcuuaccaugcgaaucaucaacgcacgcaaagaaaaaaaacggcgaggcgccgacaccagcguaggcauaguaggacuccuacuaacaacagccauggccgccgaaguaacccgacgcggcuccgccuacuacauguaucucgaccggaacgacgccggcgaagcaauauccuuccccacaacccucggcaugaacaaaugcuacauacaaaucauggaccucggccauaugugcgacgcaacaaugucauacgaaugccccaugcucgacgaaggcguugagccagacgacgucgacuguuggugcaacaccacaagcaccuggguagucuacggaacaugccaccauaaaaaaggcgaagccagacgauccaggagagcgguaacucugccaucacacuccacacgaaaacuacaaaccagaucccaaacauggcucgaaagccgcgaauacaccaagcaccucauccgcguagagaacuggauuuuccgaaaccccggauucgcccuagccgccgccgccaucgccuggcuucugggauccucgaccagccaaaaaguaaucuaccucgucaugauccucuuaauagcccccgcguacagcauacgaugcaucggaguaucgaaccgcgacuucguagagggaaugagcggcggcacauggguagacguaguacucgagcacggagguugcguaacagucauggcacaagacaaaccuacaguggacaucgaacucguaacgaccaccgucagcaacauggcggaagugcgcucauacugcuacgaagcaucgauaagcgacauggccuccgacucccgcugcccaacgcaaggcgaagccuaccucgauaaacaguccgacacccaguacgucugcaaacgcaccuuagucgacaggggauggggaaacggcugcggccuauucggcaaaggcagccuugucaccugcgccaaauucgcgugcagcaaaaaaaugacaggaaaauccauccaacccgaaaacuuagaguaccgcauaauguuaucaguccacggaucccaacacucaggaaugaucgucaacgauacaggccacgaaacagacgaaaaccgcgccaaagucgaaaucacacccaacuccccccgcgcagaagccacccuaggcggguucggaagccucggacuagacugcgagccccgcacaggacuugacuucagugaccuauacuaccuaacaaugaacaacaagcacuggcucguccacaaagaaugguuccacgacaucccccuacccuggcacgcaggagccgauaccggcacaccucacuggaauaacaaagaagcgcuagucgaauucaaagaagcacacgcaaaacgacaaacaguaguaguguuaggcucacaagaaggcgcaguccacaccgcgcuagccggagcccuagaagcggaaauggacggcgcaaaaggccgccuaucaagcggccaucuaaagugucgacuaaaaauggacaaacuccgacugaaaggcguauccuauagccugugcaccgccgcauucaccuucacaaaaauccccgcagagacccuucacggaacggucacuguagaaguccaguacgcaggcaccgacggaccaugcaaaguccccgcacaaauggccguugacaugcaaacccuaacaccagucggaagacucauaaccgccaacccagucaucacagaaaguaccgaaaacagcaaaaugaugcucgaacucgaccccccguucggcgacagcuacaucgugaucggcguaggcgaaaaaaaaauaacgcaccacuggcauagaucaggcagcaccauaggaaaagccuucgaagcaacaguacgcggcgcaaaacgaauggccguacucggcgacacggcaugggacuucggcuccgugggcggagcgcugaauagucugggcaaagguauccaccaaaucuuuggggccgcauuuaaaucccucuucggcggcaugucaugguucucacaaauccuaauaggaacacuucugauguggcugggacucaacacgaaaaacggcuccaucucccugaugugccuagcacucggcggcguacugauauuccuauccacagcagucucagcagacguaggcugcucggucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7294 - RNA, 2524 nt, Artificial Sequence
  KU926310.1 prME-long mRNA Design 2 opt
ggggcgcugccuacggagguggcagccaucuccuucucggcaucaagcuuaccaugcgaaucaucaacgcaaggaaagaaaagaaaagacggggcgcggacacaagcgucgggaucgucggucuacuacucacaaccgcaauggccgcugaagucacccgcagaggcagcgcauauuacauguaccuggacagaaaugacgcaggagaggcaaucagcuuccccacaacgcuaggcaugaacaaaugcuacauacaaaucauggaccuaggacacaugugcgaugcgacaaugagcuaugagugccccaugcucgacgaaggagucgaaccagacgaugucgacugcuggugcaacaccacaagcacgugggucguauacggcacaugccaccacaaaaagggcgaagcacgacgaagcagacgagccgucacacugccaucacacuccacacgcaaacuccaaacacggagccaaacauggcuggaaucccgggaauacaccaaacaccucauccgggucgaaaacuggauauucagaaacccaggauucgcccucgcagcugccgccauagcauggcuccuaggcucaagcacaucacaaaaagugauauaccuuguaaugauacuacucaucgcgcccgccuacucaauacgaugcauagggguaagcaaucgcgauuucguggaagguaugucagguggcaccuggguagacgucgugcucgagcacggaggauguguaacgguaauggcacaggacaaacccacggucgacaucgagcucgucaccacgacgguaagcaacauggccgaaguacgcucauacugcuacgaggcguccauaucagacauggcaucagacagccgcugccccacccagggagaggcauaccuggacaaacaaagugauacacaauacguaugcaaacggacgcucgucgacagaggcuggggcaacggauguggacuauucggcaaaggaagccuaguaacgugcgccaaauucgccugcagcaagaaaaugacaggaaaauccauacaaccagaaaaccuagaauaccgaauaaugcucucaguacacggcucacaacacaguggcaugauaguaaacgacaccggccaugaaacugacgaaaaccgcgccaaagucgaaaucacccccaacagcccgcgagcagaagcaacacucggaggauucggauccuuaggacucgacugcgaaccacgcacaggacucgauuucagcgaccucuacuaccucacgaugaacaauaaacauuggcuaguccacaaagaaugguuccacgacaucccccuacccuggcacgcaggcgccgacacaggaacaccccacuggaacaacaaagaagcacugguagaguucaaagacgcacacgccaaacgccagacagucgugguccuaggaucacaggagggggcaguccacaccgcacucgccggagcccuagaagccgagauggacggagccaaaggaagacucagcucgggccaccucaaaugcagacuaaaaauggauaaacuaagacucaaaggugucuccuacucccucuguacagccgccuucacauucaccaaaauaccagccgagacgcuacacggcaccguaacagucgaggugcaguacgcaggcgcggacggaccaugcaaggugccagcccaaauggccguagacaugcagacccucacaccgguaggccgacuaauaaccgccaaucccguaauaaccgaauccaccgaaaacucaaaaaugauguuagaacuggacccgcccuucggggacagcuacauagucaucggagugggagaaaagaaaaucacacaccacuggcacagaaguggaagcacaauagggaaagcguuugaggccaccguacgcggcgccaaacgcauggcaguccuaggagacaccgcaugggacuucggcagcgucggcggagcacucaacucacugggcaagggaauccaccaaauuuucggcgcagcauucaaaagccuauucggaggaaugagcugguucucacaaauacugaucggcacacuacuaauguggcugggacugaauaccaaaaacggaagcaucaguuuaaugugccuugcacuaggaggcguacugauauuccuaagcacagccgucuccgcagacguggggugcagcguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7295 - RNA, 2524 nt, Artificial Sequence
  KU761560.1 prME-long mRNA Design 2 opt
ggggcgcugccuacggagguggcagccaucuccuucucggcaucaagcuuaccaugagaauaauaaacgcagggaaagagaagaaacgaaggggagccgacacaaacgucggcaucgucggacuauugcuaacaacggcgauggcagccgaaguaacacgccgcggaucagcguacuacauguaccuggaccgaaacgacgccggagaagcaaucuccuucccaaccacgcucggcaugaacaaaugcuacauccaaauaauggaccuaggacacaugugcgacgccaccauguccuacgaaugcccgaugcucgacgaaggcgucgaaccagacgaugucgauugcugguguaauaccacgaguacaugggucgucuacggcacaugccaucacaagaaaggagaagcacgcagaagcagacgcgccguaacacuaccaagccauuccacaagaaaacuacagacaaggagccaaacauggcuggaaagccgcgaauacacaaaacaccuaaucagaguggaaaacuggaucuucaggaauccaggauucgcacuggccgcggcggcaauagcguggcuccuaggaagcaguacaucacaaaaaguaaucuaccucguaaugauauugcugaucgcgccagccuacucuauaaggugcauaggagucagcaaccgugacuucguagaaggaauguccggcggcaccugggucgacgucgugcucgaacacggagggugugucaccguaauggcccaagacaaacccaccguagacauagaacuggucacaacgaccguaagcaacauggcagaagugcgcagcuacugcuacgaggccucaaucagcgacauggcaagcgacucccgcugcccaacacaaggcgaagcauaccuggacaaacagagcgacacccaguaugucugcaaaaggacccucgucgaccgaggauggggaaacggaugcggccuauucggcaaaggaucccuagugacgugcgccaaauucgcaugcaguaagaaaaugaccggcaaaagcauacaaccagaaaacuuagaauacaggaucaugcucucagugcacggaucacaacacagcggaaugauagucaacgacaccggccacgaaacggacgaaaacagagccaaagucgaaauuacacccaacaguccacgcgcagaagcgacccucggaggguucgggagcuuaggacucgacugcgaaccacgaacgggacucgacuucagcgaccuguauuaccuaacaaugaacaacaaacauuggcuagugcacaaagagugguuccacgacaucccccuaccauggcacgccggggccgacacaggcacaccccauuggaacaacaaagaagcucuagucgaguucaaagacgcacacgcaaaaaggcaaaccgucgugguacuuggcagccaagaaggcgcaguccacacugcacuagcaggagcgcuagaagccgaaauggacggagcaaaaggccgccuauccucggggcaccucaaaugcagauugaaaauggacaaacuaagacugaaaggaguaucauacucccucugcaccgcugccuucaccuucaccaaaauacccgcagaaacccuccacggaacgguaacagucgaaguacaguaugccggaaccgacggccccugcaaggucccagcccaaauggccgucgacaugcaaacacuaaccccaguuggccgccuaaucacggccaacccaguaaucacagaaucaaccgagaacuccaaaaugaugcucgaacucgacccacccuucggagacagcuacaucguaaucggcgucggcgaaaagaaaauaacccaccacuggcaccgcagcggaagcacaauuggcaaagcguucgaagcaacggucagaggcgcacgcagaauggcaguucucggcgauacagcaugggauuucggcagcguaggaggggcgcucaacucccucgggaaaggcauacaucaaaucuuuggggcagcguucaaaagccuguucggcggcaugucaugguucagucaaauccuaauaggaacacuccuaauguggcucgggcuaaacacgaaaaacggguccaucagcuuaaugugccucgcacucggaggaguacucaucuuccuauccacagcuguaagcgcagacgucggaugcucaguggacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7296 - RNA, 2524 nt, Artificial Sequence
  KY317939.1 prME-long mRNA Design 2 opt
ggggcgcugccuacggagguggcagccaucuccuucucggcaucaagcuuaccaugcgcauaaucaacgccagaaaagagaagaaacgacgaggagcagaaaccagcguggggauagugggccugcuccuaaccacagcaauggcugccgaagugacacgaagaggaagcgccuauuacauguaccuggacagaaaagacgcaggagaagccaucagcuuuccaaccacacucgggaugaacaaaugcuacauccagauaauggaccuaggccacaugugcgacgcaaccaugucauacgaaugccccauguuagacgaaggcguggagccggacgacguagacugcuggugcaacaccaccagcacuugggugguguacggaacaugccaccacaagaaaggcgaagccagacgcagcagacgagccgucacgcuccccagccacuccacacggaaacuacagacacgaagccaaacauggcuagaaagccgcgaauacaccaaacaccuaaucagagucgagaacuggaucuuccgcaaucccggcuucgcauuagccgcagccgcaauagccuggcuacuaggcagcagcacaucccaaaaaguuaucuaucuugugaugauacugcuaauagcccccgcguacucaauccggugcaucggcgucucaaaccgggacuucguagaaggcaugucaggcggcaccugggucgacgucguacuagaacauggaggaugcgucaccguaauggcccaagacaaacccaccguagacaucgaacucgucacgacuaccgucaguaacauggcagaagugcgauccuacugcuacgaagccagcaucuccgacauggccuccgacagccgcugcccaacacaaggcgaagcauaccucgacaaacaaagcgacacacaauacgugugcaaacgaacccuagucgaccgcggaugggguaacggaugcggccucuucggaaagggcagccuagugaccugcgcaaaguucgcaugcagcaagaaaaugacaggcaaaaguauccagccagaaaaucuggaguacagaauaaugcuuucaguacacggaucacaacacucaggaaugaucgucaacgacacaggccaugaaacagacgagaaccgcgcgaaaguagaaauaacccccaacagccccagagcagaagcaacacucggaggguucggcagccuaggacucgacugcgaaccacgaaccgggcuagacuucagcgaccuauacuacuuaacaaugaacaauaaacacuggcucguucacaaagaaugguuccacgacaucccccuaccauggcaugcaggagccgacaccggaacgccccacuggaacaacaaggaggccuuaguagaguucaaggacgcacacgcgaagcgacaaaccguagucguccuaggaucccaagaaggagccguacacacagcacuggccggcgcccucgaagcagaaauggacggggcaaaaggccgacuaagcagcggccaccuaaagugcagacugaagauggacaaacugagacucaaaggcgucuccuacagccucugcaccgccgcauucacauucaccaagauaccagcggaaacacuacacggaaccgucaccguagaagugcaauacgcaggcacugacggccccugcaaagucccagcacaaauggcaguagacaugcaaacacucacaccaguaggacgacucaucaccgccaacccaguuaucaccgagucaacagaaaacucaaaaaugaugcucgaacucgacccgcccuucggcgacagcuacaucguaauaggagugggagaaaagaaaauaacgcaccacuggcaccggagcggcagcacaauaggaaaagcauucgaagcaacagucagaggcgccaaaagaauggccguccucggcgacacggcaugggacuucgggagcgucggaggcgcauuaaacucccuggggaaaggaauccaccaaauuuucggagccgccuucaaaagccuauucggcgggaugucaugguucagccaaauccucauugggacccuacuaauguggcuaggccugaacacgaagaacggaagcauaucacuaaugugccuagcacuagggggaguccuaauauuccuauccacggcgguaagcgcagacguaggaugcuccguagacuucagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7297 - RNA, 2524 nt, Artificial Sequence
  KY075937.1 prME-long mRNA Design 2 opt
ggggcgcugccuacggagguggcagccaucuccuucucggcaucaagcuuaccaugcgaaucaucaacgcgagaaaagaaaagaaaagacguggagcggacacguccgucggaaucgucggacuauugcuaacgacggcuauggccgcggaagucacacgcagaggcagcgccuacuacauguaccucgaccgcaacgacgcuggcgaagcgaucagcuuccccaccacccuuggaaugaacaaguguuacauccagauaauggacuuaggacacaugugcgacgccaccauguccuacgaaugcccuaugcuugacgaaggcgucgagccagacgacguggauugcuggugcaacacaaccagcacauggguaguauacggaaccugccaucacaagaaaggcgaagcccgaaggaguagacgagccguaaccuuaccaucgcacucaacacgaaaacuacaaacccgcucccaaacauggcuagaaucccgcgaauacacaaaacaccucauccgcgucgaaaacuggauauuccgcaaccccggauucgcacuagccgccgccgcaaucgccuggcuacucggaagcucaaccucgcaaaaagucauauaccucguaaugauacugcuaauagcaccggcauacuccauacgauguaucggcguguccaacagggacuucgucgaaggaauguccggaggaaccugggucgacgugguacuagagcacggaggcugcgucacagugauggcccaggacaaaccaacagucgacauagagcuagucacaacaaccguguccaacauggccgaaguaagguccuacugcuacgaagccagcauaagcgacaugguaucagauucgcgaugccccacccaaggcgaagcauaccucgacaaacaaagcgacacccaguacguaugcaaacgcacgcucgucgacagaggauggggcaacggaugcgguuuauucggcaaaggaagccuaguaaccugcgcaaaauucgccugcaguaagaaaaugaccggaaaauccauacaaccagaaaaccuagaauaccgcaucaugcucuccguccacggaucacaacacagcggaaugauagucaacgacacgggacacgaaaccgacgaaaacagggccaaaguagaaauaaccccaaacaguccccgugcagaagcaacacucggcggguucggcucacucggccucgacugcgaaccaagaaccggccuagacuucuccgaccucuacuaccuaacaaugaacaacaaacacuggcucguacacaaagaaugguuccacgacauaccccuaccauggcacgccggcgccgacaccggcacuccacacuggaacaacaaggaagcccucguagaguucaaagacgcacacgcuaaacgccaaaccgucguaguccucggaagccaggaaggagccguccacaccgcccuggcaggggcccuggaagcugaaauggacggagcaaaaggcagacucucaagcggccaccuaaagugccgacucaaaauggacaaacucagacuaaagggaguaagcuacagccucugcacagccgcauucacauucaccaaaaucccagccgaaacucuacacggcacagucaccguagaaguacaauacgccggaacagacggaccguguaaaguaccagcucaaauggccguggacaugcaaacacugacacccgucggaagacucauaaccgccaacccagucauaaccgaaucgaccgaaaacagcaagaugaugcuagaacuagacccgcccuucggagacagcuacaucguaaucggcguaggggaaaagaaaauaacccaccacuggcacagaucaggcuccacaauaggaaaagccuucgaagccacaguacgaggcgccaaacgaauggcuguauuaggugacacggcaugggacuuuggaucaguaggcggcgcccuaaacucacuaggaaaaggcauccaccaaaucuucggggcagccuucaagucgcucuuugggggcauguccugguucucgcaaauccucaucgggacccuccuaauguggcuaggacucaacaccaagaacgguucgauaucccugaugugccucgcucucggaggaguccucaucuuccucuccacugccgucagcgccgacguuggcugcucggucgauuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7298 - RNA, 2524 nt, Artificial Sequence
  LC191864.1 prME-long mRNA Design 2 opt
ggggcgcugccuacggagguggcagccaucuccuucucggcaucaagcuuaccaugagaaucauaaacgcaagaaaagaaaagaaaagaagaggcgcggauaccaaugucggaaucgugggacuccuacuaacaacggcaauggcagcggaaguaacccgacgaggcagcgcauacuacauguaccucgacagaaacgacgcaggagaagcaaucagcuuccccaccacucuaggcaugaacaaaugcuacauccaaauaauggaccucgggcacaugugcgacgcgacaauguccuacgaaugccccaugcuggacgaaggcguagaacccgacgacgucgacugcuggugcaacaugacgagcacauggguaguauacgggacgugccaccacaagaaaggcgaagcacgacgaagccgccgggcaguaacccucccaagccacagcacgcgcaaacuacagacucgcucacaaaccuggcucgagagccgagaauacacaaagcaccuaauccgcguagaaaacuggaucuuccgaaaccccggcuucgcacuagcagcagcagcgauagcguggcuacugggcucaagcaccagucagaaagucaucuaccugguaaugauacuacuaauagcaccagccuacagcaucaggugcauaggcguaagcaaccgagacuucguagaaggaaugagcggaggcaccuggguggacgucguucucgaacacggagggugcgucacaguaauggcccaagacaaacccacaguggacaucgagcuaguaacaaccacagucagcaacauggcagaaguccgcucauacugcuacgaagccuccaucuccgacauggccagugacucacgcugcccaacacaaggagaagccuaccucgacaaacaaucagacacacaguacgucugcaaacgcacacuggucgaccgcggauggggaaaugggugcggacuauucggaaaaggaucccucguaaccugcgccaaauucgccugcaguaagaaaaugacaggcaaaucaauccagccggaaaaccuagaauaccgcaucaugcucagcguccacggcagccaacacagcgguaugauaguaaacgacacaggacacgaaacagaugaaaaccgcgcaaaagucgagaucacacccaacagcccccgcgccgaagcaacccuagguggguuuggcagccugggacuagacugcgaaccacgaaccggacucgacuucuccgaccuauacuaccuaacuaugaacaauaaacacuggcucguacauaaggaaugguuccacgacaucccacuaccauggcacgcuggagccgacaccggaaccccgcacuggaacaacaaagaagcgcucguagaguucaaagacgcacacgccaaacgacaaacagucguuguacucgguagccaggaaggagcaguacacacagcacucgccggagcacuagaagcagaaauggacggagcaaaaggacgacugagcagcggccaccugaagugcagacucaaaauggacaagcuccgccucaaaggagucagcuacagccucugcaccgccgcguucaccuucacaaaaauaccagcggaaacacuucacggaacgguaacaguggaaguacaauacgccggaacagacggacccugcaaagucccagcccagauggccgucgacaugcaaaccuuaaccccagucggccgccuaaucaccgcaaaccccgucaucaccgaauccaccgaaaacuccaaaaugaugcuggaacuagacccacccuuuggagacuccuacaucguuauaggaguaggcgagaaaaagaucacccaccacuggcaccgcuccggaagcacgaucggcaaagccuucgaagccaccguccggggagccaaacgcauggcaguacuaggagacacagcaugggacuucggaagcgugggcggggcccugaacagccuaggcaaaggaauccaccagauauucggcgccgccuucaaaagccuauucggcggcauguccugguucucgcaaauacuuaucggcacacuauuaauguggcucggacucaacacaaagaacggcucaaucagccuaaugugucucgcucugggaggaguccuaauauuccucagcacggcagucagcgcggacgucggcugcucagucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7299 - RNA, 2524 nt, Artificial Sequence
  KX447517.1 prME-long mRNA Design 2 opt
ggggcgcugccuacggagguggcagccaucuccuucucggcaucaagcuuaccaugcgcauaaucaacgcccgaaaagagaaaaagcgacgcggggccgacacgagcgucgguauaguaggccuacuucugaccacagccauggcggccgaagucacgcgccggggcagcgccuacuacauguaccuagaccgaaacgacgcaggagaagcaaucagcuucccaaccacgcuaggcaugaacaaaugcuacauacaaaucauggaccuaggucacaugugcgacgcaaccaugagcuacgaaugcccuaugcuagacgaaggagucgaacccgacgacguggacugcuggugcaacaccacaagcacaugggucgucuacggaaccugccaucacaaaaagggcgaagcacgcagaagccgacgcgccgucaccuugccaagccacagcacccggaaacugcaaacaagaagccaaacguggcuagaaagucgcgaauauaccaaacaucucauacgcgucgaaaacuggaucuuccgaaaccccggcuucgcacucgcagcggccgcaauagcauggcuccuaggguccagcacaagccaaaaaguuaucuaccucguaaugauccuacucaucgcuccagcauacuccauacgaugcaucggcgucagcaaccgagauuucgucgaaggaauguccggaggcaccuggguagacgucguacucgagcacggcggcugcgucaccgucauggcccaagacaaaccaacugucgacauagaacucgucaccaccaccgucucaaacauggccgaagugcgcagcuacugcuacgaagcgagcaucagcgacauggccagcgacuccagaugucccacucaaggagaagccuaccucgacaaacaauccgacacccaauacgugugcaaacgcacgcuagucgaccgaggauggggaaauggaugcggacucuuuggaaaagguucguuaguaaccugcgccaaauucgcaugcuccaaaaagaugacaggcaaaucaauacagccggaaaaccucgaauacagaaucaugcucagcguccacggcagccaacauagcggaaugaucguaaacgacacgggacacgaaacagaugaaaauagggcaaaagucgagaucaccccuaacaguccccgagccgaggcggcacuaggcggauucggaucacuaggacucgacugcgagccccgcacuggccuggacuucuccgaccucuacuaccucaccaugaacaacaaacacuggcuagugcacaaggaaugguuccacgacaucccccuacccuggcacgccggcgccgacaccggaacuccccauuggaacaacaaagaagcacuggucgaauuuaaagacgcacacgcgaaacgacaaacagucguaguacucggaucccaagaaggugccguccacacagcacuagccggagcgcuggaggcagagauggauggcgccaagggccggcucuccuccggccaccuaaagugucgucuaaaaauggacaaacuccgccuaaaaggcgugucguacagccuaugcaccgcagccuucaccuucaccaaaauccccgccgagacacuacacggaaccgucacagucgaaguccaauacgccggcacagacggcccgugcaaagugccggcccaaauggcaguggacaugcagacccuaacaccagucggacggcuaaucacagccaaucccguaaucacagaaagcacagaaaacagcaaaaugauguuagaacuagaucccccauucggcgacagcuacauagucauaggcgucggagagaagaaaauaacacaccacuggcacagaagcggcagcacaaucggaaaagcauuugaagcaaccguccgcggagcaaaaagaauggcaguacugggcgacaccgcaugggacuucggaucaguaggcggcgcacuaaacucauuaggcaaagggauacaccaaauauucggagcugcauucaaaagccucuucgggggcaugagcugguucucacaaacacucaucggcacccuacugauguggcugggacuaaauaccaaaaacggaagcaucucgcucaugugccucgccuuaggaggaguccuaaucuuccucagcaccgcuguaagcgccgacgucggcugcagcgucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7300 - RNA, 2524 nt, Artificial Sequence
  KU922923.1 prME-long mRNA Design 2 opt
ggggcgcugccuacggagguggcagccaucuccuucucggcaucaagcuuaccaugcgcauaaucaaugccaggaaagaaaagaaaaggcgcggcgcagaaaccucagugggaaucgucggacuacuacugaccacagcaauggccgccgaggugacacgacgcggaucugccuacuacauguaccuagaccgaaacgacgcuggcgaagcgaucuccuuccccacaacccucggaaugaauaaaugcuacauacaaauaauggaccuaggccacaugugugacgccacaauguccuacgaaugcccaaugcucgacgaagguguggaacccgacgacguggacugcuggugcaacacaacgucaacguggguaguauacggaaccugccaccacaagaaaggagaagcaagaagaagccgacgagcuguaacacucccgagccacagcacgcgaaaacuccaaaccagaagccaaacguggcuagaaagcagagaauacaccaaacaccuaauacgcgucgagaacuggauauuucgaaaccccggauucgcacucgcagccgccgcaauagccuggcuacuaggcaguucaaccagucaaaaagucaucuaccuaguuaugauacuacucaucgcacuagcauauagcauccgauguauaggggucucaaaccgcgacuucguagagggaaugagcggcggcaccuggguagacgucguccucgaacacggcggaugcguuaccguaauggcgcaggacaaacccaccguggacauagagcuaguuaccacgacaguaagcaacauggcggaagucagaucauacugcuacgaagcaagcaucagcgacauggcaagcgacagcagaugcccaacgcaaggagaagccuaccucgacaaacagagcgacacacaauacgucugcaaacgcacgcuuguagaccgaggauggggcaacggaugcggacuguucggaaaaggcucauuagucacaugcgccaaauucgcgugcagcaagaaaaugaccggaaaaaguauccaacccgaaaaccucgaauaccgaaucaugcucuccguccacggaucacagcacagcggaaugauaguaaacgacacaggacacgaaaccgaugaaaaccgggcgaaaguagaaaucacuccaaacuccccuagagcggaagccacacuaggcggcuucggaagccuaggccucgacugcgaaccacgcacgggccucgacuucagcgaccucuacuaccuuaccaugaacaacaaacacuggcugguacacaaagaaugguuccacgacaucccccuaccauggcacgcaggagcagacacaggcacaccccacuggaacaauaaagaggcacucgucgaguucaaagacgcccacgcaaaacgacaaaccgucgucguccuaggaagucaagaaggcgcgguccacacggcacucgccggugcgcuagaagcagagauggacggcgcgaaaggacgacuaagcuccggacaucucaaaugcaggcucaaaauggacaaacuccggcugaaaggaguaagcuacucgcucugcaccgcugccuucacauucaccaaaauccccgccgaaacacuccacggcaccgucaccgucgagguacaauacgcaggcacagauggaccgugcaaagucccagcacaaauggccguagacaugcaaacacugacacccgucggacgacucaucaccgcuaaccccgucaucaccgaaaguaccgagaacagcaaaaugaugcuagaacucgacccgcccuucggagacucauacaucguaaucggagucggggaaaagaaaauaacacaccauuggcaccgauccggcuccacuauaggaaaagcguucgaagccacgguacgcggugccaaacgaauggcaguccucggcgacaccgccugggacuucggaagugucggaggcgcauuaaacucccucggcaaaggaauacaccaaaucuucggcgccgcauucaaaagccuauucggaggaauguccugguucucccaaauacugauagggacacuccucauguggcucggucuaaacaccaaaaacggaagcaucucccucaugugccuugcccuuggaggaguacucaucuucuugucaacagccguaagugcugacgucggcugcagcgucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7301 - RNA, 2524 nt, Artificial Sequence
  KY003156.1 prME-long mRNA Design 2 opt
ggggcgcugccuacggagguggcagccaucuccuucucggcaucaagcuuaccaugcgaaucauaaacgcuaggaaagagaagaaacggcgaggagcggacacauccgugggaauaguuggccugcuccuaacaaccgcaauggcggcagaaguaacgcgccgaggcuccgccuacuacauguaccuagaccguaacgaugcuggggaggcaauauccuucccuaccacccucggcaugaacaaaugcuacauccaaauaauggaccucggacacaugugcgacgccacaauguccuacgagugcccgaugcuagacgaaggcgucgaaccagacgacgucgacugcuggugcaauacaaccagcaccugggucguauacggcacuugccaccacaagaaaggagaagccagacgcagcagacgagccgucacgcucccaagccacuccacccgcaaacuacagacccgaucccaaacauggcucgaaagccgagaauacacaaaacacuuaauccgcgucgagaacuggaucuuccgcaaccccggcuucgcacucgcagcggccgccauagccuggcuccucgggagcagcaccucccagaagguaaucuaccuggugaugauacuccuaauugcacccgccuacuccauacggugcauaggcauauccaaccgagacuucgucgaaggcaugucaggaggaaccugggucgacgucguucuagaacacggaggcugcguaaccgucauggcccaagacaaaccaacagucgacauagagcuagucaccacaaccgucuccaacauggccgaagucagaaguuacugcuacgaggcaagcaucagcgacauggccagcgacagccgcugccccacacaaggagaagcauaccucgauaaacaaucagacacccaauacgucugcaaacgcacacugguagacagaggauggggcaacggcugcggucucuucgggaaaggcucacugguaaccugcgccaaauucgccugcuccaagaaaaugacagggaaauccauacaaccagaaaaccuagaauaccgcauaaugcuaucuguccacggaucacaacacuccggcaugauaguaaacgacaccgggcacgaaaccgacgaaaacagagccaaaguagaaaucacccccaacagcccccgcgcggaagcaacacucggaggauucggcauacuaggacuggacugcgaacccagaaccggacuggauuucagcgaccuuuauuaccucacaaugaacaauaaacacuggcugguccauaaagaaugguuccacgacauacccuuacccuggcaugcgggagcagacacaggcacaccgcacuggaacaauaaagaagcccucgucgaguucaaagacgcccacgcaaaaaggcaaaccgucguaguccugggcucccaagaaggagccguacacaccgcacucgccggcgcccuagaagcagagauggacggggccaaaggccgacuaagcuccggccaccucaaaugccgucuaaaaauggacaaacuacgcuuaaagggcgugucauacucacucugcacagcagccuucacauucaccaaaauaccggcagaaacacugcacggcacagucacaguggaagugcaauaugccggcacagacggcccauguaaagucccagcccaaauggcaguagacaugcaaacgcuaacaccagugggccgccuaauaacagccaaccccgucaucacagaaaguacagaaaacucaaaaaugaugcuagagcuagaucccccauuuggcgacucauacauaguaauaggcgucggcgaaaagaaaaucacccaucacuggcaccgaucaggaagcacaauuggaaaagccuucgaagcgacaguaagaggagccaaacgaauggcaguacugggagacacagccugggacuucggaagcgugggcggagcacugaacucgcuaggaaaaggcauccaccagaucuucggcgcagccuucaagucacucuucggcggcaugagcugguucucccagauacucaucggcacgcuccucauguggcuaggacuaaacacgaaaaacgguagcaucucacugaugugccucgcccucggaggaguccucauauuccuaucgacagccguaagugccgacgugggaugcuccgucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7302 - RNA, 2524 nt, Artificial Sequence
  KU312313.1 prME-long mRNA Design 2 opt
ggggcgcugccuacggagguggcagccaucuccuucucggcaucaagcuuaccaugcgcaucauaaacgccagaaaagaaaagaaaaggcguggcgccgacacauccguaggaauagucggucuacuacucaccacagccauggcagccgaagucacaaggagaggcucagcauacuacauguaccucgaccgcaacgaugccggagaggccauuucauucccaacaacccuaggaaugaacaaaugcuacauccaaauaauggaccucggccauacaugcgacgccacaauguccuacgaaugcccuaugcucgacgaaggaguagaaccggacgacgucgacugcuggugcaacaccaccucaaccugggucguguacggaacaugccaccacaagaaaggagaagccagacgcagccgccgggcagugacccuccccucccacucgauccgcaaacuccaaacacgcagccaaaccugguuagaaucacgagaauacaccaaacaucuaaucagggucgaaaacuggaucuuccgaaacccaggcuucgcacucgccgcagccgcaauagcgugguuacucggaagcuccacaagccaaaaagucaucuaccucguaaugauacuucuaauagcaccagccuacagcauccgcugcaucggagucagcaaccgagacuuugucgagggcaugagcggcggcaccuggguggacgucguacucgaacacggcggcuguguuacggucauggcccaggacaagcccacagucgauauagaacucgucacuacaaccgucagcaacauggcugaaguacgaagcuacugcuacgaggccuccauaagcgacauggcaagcgacucccgcugccccacccaaggcgaagcauaccuugauaaacaauccgacacacaauauguaugcaaacgcacacucguagacagaggguggggaaacgggugcggacucuucggcaaaggaucccucguaaccugcgccaaauucgccugcuccaaaaagaugaccggaaagagcauccaacccgaaaaccucgaauaucggaucaugcucuccguccacggaucccaacauagcggaaugaucguaaacgacacagggcacgaaaccgacgaaaaccgcgcaaaaguagaaaucaccccgaacagcccccgcgcggaagccacccucgggggcuucggaagccugggccucgacugcgaaccccgaacaggacuagacuucuccgaccucuacuaccuaaccaugaacaacaaacacuggcucguccacaaagaaugguuccacgacauaccccuaccauggcacgcaggcgccgacacgggcacaccgcacuggaacaacaaagaggcauuagucgaauuuaaggacgcgcacgcaaaacgccagacaguagucgugcugggcucacaagaaggcgccguacacaccgcccuugccggcgcacuagaagcagagauggacggcgcaaaaggcagacuauccuccggccaccuaaaaugcagacuaaagauggacaaacuccggcugaaaggaguguccuacagccuuugcaccgcugccuucacguucacaaaaauccccgccgagacccuccacggaacgguaacaguagagguccaguacgcaggcaccgacggaccgugcaaagucccagcccaaauggccgucgacaugcaaacgcucacccccgucggccgacugauaaccgcgaacccagucaucaccgaguccaccgaaaacuccaaaaugaugcuagaacuagacccaccauucggggacucauacaucgugauaggaguaggcgaaaagaaaaucacccaccacuggcaucguuccggcuccacaaucggcaaagcauucgaagccacagucagaggcgccaaacgaauggccgugcucggagacaccgccugggacuucggaagcguaggcggcgcccucaacucccucggaaaaggaauccaccaaaucuucggggccgccuucaagucccucuucggcggaaugucaugguucucucagauacucaucggaacucugcucauguggcuagggcuuaacgccaagaauggcucgaucucacucaugugccuagcauuaggaggaguccucauauuccuaagcaccgcgguauccgcagacguagggugcagcgucgacuucaguaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7303 - RNA, 2524 nt, Artificial Sequence
  KY075935.1 prME-long mRNA Design 2 opt
ggggcgcugccuacggagguggcagccaucuccuucucggcaucaagcuuaccaugcgaauaauaaacgccagaaaagaaaagaaacgacgaggagccgacaccucaguaggcaucguaggacuacuacucacgacagcaauggcagcagagguaacccgccgcgggagugcauacuacauguaccuugacagaaacgacgcgggagaagcgauauccuucccaacaacgcucgggaugaacaaaugcuacauccaaauaauggaccucgggcauaugugcgacgcaacaaugucguacgaaugcccaaugcuagacgaaggcguagaaccagacgacgucgacugcuggugcaacacaaccagcaccugggucguauacggcacgugucaccacaagaaaggagaagcccaacgcuccaggcgagccgucacgcuccccagccacagcacccgaaaacuccaaacccgcagccagacauggcucgaaucaagagaauacaccaaacaccuaauacgagucgaaaacuggaucuuccgcaaccccggauucgcccucgcagccgcagcgauagcguggcuccugggcagcaguaccagccagaaaguaauauaccuugucaugauacuccucauagcccccgccuacaguauacgcugcauaggcguaagcaaccgcgacuucguagaaggaaugagcggcggaacaugggucgacguggucuuagaacacggcggcugugugacaguaauggcacaagacaagcccaccguagacauagaacuggucacaacaacaguaagcaacauggcagaaguccgcucguacugcuacgaggcuucaaucuccgacauggcaucagacucaaggugcccaacucaaggagaagcauaccucgacaaacaauccgacacccaauacgucuguaaacgaacacuugucgaccgcggaugggggaacggaugcggccucuucgggaaaggaucccucguaaccugcgccaaauucgcgugcucgaagaaaaugacgggaaaaagcauacagcccgaaaaccuugaauacagaauaaugcucagcguccacggaucacaacacagcggcaugauagucaacgacacaggccacgaaaccgaugaaaaccgggccaaaguagaaaucacgccaaacuccccacgagccgaagcgacacucggaggcuucggaucccuggggcuagacugcgaaccucgaacaggcuuggacuucagcgaccuguacuaccuaacaaugaacaacaaacacuggcugguacacaaagaaugguuccacgacaucccacuccccuggcacgccggagcagacaccggaaccccucacuggaacaacaaagaagcacucgucgaguucaaagacgcacacgccaaaagacaaacaguagugguccucgggagccaagaaggagcaguacacacagcccucgcaggcgcccucgaagcagagauggacggagcaaaaggacgccugagcucaggacaccuaaaaugcagacuaaaaauggacaaacuccgacuaaaaggcgucucuuacucacuauguacagcagcguuuaccuucacaaaaaucccagcggaaacauuacacggaaccgucaccgucgaaguacaauaugccggaaccgacggcccaugcaaaguccccgcacaaauggcagucgacaugcaaacacucacccccgucggacgccugaucacagcgaacccaguaaucaccgagucaacggagaacagcaaaaugaugcuagagcuggacccgccauuuggagauuccuacauagucaucggcgucggagagaagaaaaucacacaccacuggcaucgcagcggaagcacaauagguaaagcauucgaagcgacaguccguggagcaaaaaggauggcgguccucggcgauaccgcaugggacuucggcagcguaggcggagcccuaaacagccucggaaaaggcauacaccaaaucuucggcgccgccuucaaaagccuauucggcggaaugagcugguucagccaaauccuaauaggcacacuccucauguggcucggccucaacaccaaaaacggaagcaucagccucaugugccuagcccucggcggcguccuaaucuuccugucaacagccgugagcgcagacgucggcugcagcguggacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7304 - RNA, 2524 nt, Artificial Sequence
  KY014320.1 prME-long mRNA Design 2 opt
ggggcgcugccuacggagguggcagccaucuccuucucggcaucaagcuuaccaugcgcauuaucaacgcgcgaaaagagaaaaagagacgaggcgcagacaccuccguaggcaucgucggccuacugcucaccaccgccauggcagcagaagucaccagaagagguucagcguauuacauguaccucgaccgaaacgacgcaggggaagcaaucagcuucccaaccacccuaggaaugaacaagugcuacauacaaaucauggaccugggacacaugugcgacgccaccaugucauacgaaugcccgaugcucgacgaaggaguagaacccgaugacgucgacugcuggugcaacaccaccagcaccuggguagucuacggaaccugccaccacaagaaaggcgaagcacgacgcucgcgcagagcagucacccucccaucacacucaacaagaaaacuacaggccagaucacaaacauggcucgaaucccgagaguauaccaaacaccugauccgcgucgaaaacuggauauuccgaaaucccggcuucgcacuggccgccgccgccauagccuggcugcucggcagcagcaccagccaaaaagugaucuaccucgucaugauacugcucauagccccagccuacucaauacgcugcauaggaguaucaaacagagacuucgucgaggggaugucaggaggcaccuggguagacgucguccucgaacacggcggaugcgugacagucauggcccaggacaaacccacaguagacaucgagcuagucacaacaacagucucaaacauggccgaaguucgcucauacuguuacgaagccagcaucagcgacauggcgagcgacucacgcugcccgacccaaggagaagccuaccuggacaaacaguccgacacgcaguacgucugcaagagaacccuaguagacaggggcuggggcaacggcugcgggcuauucgggaaagguagccuuguaaccugcgccaaauucgccugcuccaagaaaaugaccggcaaaucgauccagcccgaaaaucuagaauaccgcauaaugcucuccgugcacggcagccaacacucaggcaugauuguaaacgacacuggccacgagacggacgaaaaccgcgcaaaagucgaaaucacaccaaacuccccacgcgcggaggcaacccucggaggcuucggaagccuaggccucgacugugaaccccgcaccggccuagacuucucagaccuuuauuaccucacaaugaacaacaaacacuggcucguucacaaagaaugguuucacgacaucccgcuccccuggcacgcaggcgccgacacaggaacaccccacuggaacaacaaagaagcccuagucgaguucaaagacgcacacgcaaaacgccaaaccgucgucguacucggcucgcaagaaggagcaguacacaccgccuuggcaggcgcccucgaagccgaaauggacggcgccaagggccggcucagcuccggccaccucaaaugccgccuaaaaauggacaaacuacgacuaaaaggaguaagcuacagccuaugcaccgcugcauucacuuucacaaaaauacccgcagaaacccuacacggcaccgucacggucgaaguucaauacgccggcaccgacggacccugcaaagucccagcccaaauggcaguagacaugcagacacucaccccagucggaagacuaaucaccgcaaacccaguaauaacagaauccaccgaaaacagcaaaaugaugcucgaacucgacccgccguucggagacagcuacaucguaaucggcguaggcgaaaagaaaauaacacaccacuggcaccgauccggcuccaccaucggcaaggccuucgaagcaaccguacgaggagccaaacgaauggcaguacucggagauacggcuugggauuucggcagcgucgggggagcccuaaacucacuaggaaaaggcauccaucaaaucuucggagcggcuuuuaaaagucuauucggaggcaugaguugguucagccagauacuaaucggcacacuacuaauguggcucggccucaacaccaaaaacggauccaucucacuaaugugucucgcccuaggcggaguacuaauauuccucagcaccgccgucagcgccgacguaggaugcaguguggacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7305 - RNA, 2524 nt, Artificial Sequence
  KX827309.1 prME-long mRNA Design 2 opt
ggggcgcugccuacggagguggcagccaucuccuucucggcaucaagcuuaccaugcgcaucaucaacgcgcgcaaggagaagaaacgccgaggcgcagacacauccgucggaaucguagggcuacuccucacaaccgcaauggccgcagaagugacacgacgcggaucugcauacuauauguaccuagacagaagcgacgcaggagaagcaauuagcuucccaacgacccucgggaugaacaaaugcuacauacaaauaauggaccucggacacaugugcgacgcaacgaugucuuacgaaugccccaugcuagacgaagggguggaacccgacgacgucgacugcuggugcaacaccacaagcacguggguagucuacggaaccugccaccacaagaaaggcgaagcccgcaggagcaggagagccguaacacuccccucccacagcacccgaaaacugcaaacgagaucacaaacguggcucgaauccagagaauauacaaaacaccuaaucagagucgagaacuggauauucagaaacccagguuucgcccuagcagcagcagcaauagccugguuacuaggaagcagcaccagccaaaaaguaauauaccuaguaaugauacuccucauagccccagcauacagcauacgguguaucggaguaagcaaccgagacuucgucgaaggaaugucgggaggaacauggguagacguaguacucgaacacggcggcugcguaacagucauggcccaagacaaaccaacaguagacauugagcuagugacuacaacagucagcaacauggcggaaguccgcucguacugcuacgaagcaucgaucagcgacauggcaagcgacaguagaugccccacacagggcgaagccuacuuagacaaacaaucagacacccaauacguauguaaaaggacccuagucgaucgcggauggggcaacggaugcgggcuauuuggcaaagguucacucguaaccugcgcgaaauucgcgugcaguaagaaaaugacaggcaaaaguauacaaccagaaaaccucgaguaccgcauaaugcuaucgguccacggcucccaacacagcggcaugaucgucaacgacacgggacacgaaaccgacgaaaacagagcaaaagucgagaucacaccaaacucaccacgagcagaggcaacccuuggcggauucggcagucucggacucgacugcgaaccgcggacaggccucgacuucucagaccuauauuaccuaaccaugaacaacaaacacuggcuaguacacaaagaaugguuccacgacauaccacuaccauggcacgccggcgccgacaccggcacaccacacuggaacaacaaagaagcacucguagaguucaaagacgcgcacgcgaaacgacaaacaguaguaguacuaggcucacaagaaggagcaguccacacagcacuggccggcgcacuagaagccgaaauggacggcgcaaaaggacgucuaaguagcggucaccuaaaaugccgacuaaaaauggauaaacuacgccuaaaaggggucucauacucgcucugcaccgcagcauucaccuuuacgaaaaucccagccgaaacccugcacgggacaguaaccguagaaguccaauacgccggcaccgacggcccaugcaaaguaccagcccaaauggccgucgacaugcaaacccugaccccggugggaagacugaucacagccaacccagucaucacagaaagcacggagaacagcaaaaugaugcuggaacuugacccacccuucggcgacagcuacaucguaauaggggugggagaaaagaaaauaacacaucacuggcaccgcucagguagcacaaucggcaaagcauucgaggcaacagucagaggagcaaaacggauggcaguccuaggagacacagccugggauuucggaagcguaggaggggcgcucaauucacuaggcaagggcauccaccaaauauucggagccgccuucaagucacuguucggcggaaugagcugguucagccaaauccucaucggcacacuauuaaugugguuaggacugaacacuaaaaacggauccaucagccucaugugccucgcgcugggcggcguacugauauuccugagcacagccguaagcgccgacgucgggugcucaguagacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7306 - RNA, 2524 nt, Artificial Sequence
  KU681081.3 prME-long mRNA Design 2 opt
ggggcgcugccuacggagguggcagccaucuccuucucggcaucaagcuuaccaugcgcauaauaaacgccagaaaagaaaagaagagaaggggaacagacacauccgugggcaucgucggccuccugcucacaacagccauggcagccgaagucacccgaagaggcagcgcauacuacauguaccuagacaggucagacgcaggcgaagcaauauccuucccaacaacacuaggaaugaacaaaugcuacauccagauaauggacuuaggacacaugugcgacgcaacgaugucauacgaaugccccauguuagacgaaggaguugaaccagacgacguggacugcuggugcaacacuacaucaacgugggugguguacggaacaugccaccacaagaaaggagaagcgcgcagauccagacgagcagugacccuaccaagccauagcacccgaaaacuccaaacaagaagccaaaccuggcuggagagcagggaauauaccaaacaccucauaagggucgagaacuggauauucagaaacccaggcuucgcacucgccgcagcagccauagccuggcuccuaggcucaagcacaagccaaaaaguaauauaucucgugaugauccuacuaaucgcaccagcauacucaauacgcugcaucggcgucaguaacagggacuucguagaagggaugucgggaggcacauggguggacguuguacucgagcacggaggaugcgucaccgucauggcacaagauaaacccacaguggacaucgaacucguaacuaccacagugucuaacauggcagaaguacgaucauacugcuacgaagcgucgauaucagacauggccagugacucccggugcccgacacaaggagaagcauaccucgacaaacagagcgacacacaauacguauguaaaagaacgcugguagaccgcggauggggcaacggcugcggacucuucggcaaaggaucccucguaaccugcgcaaaauucgcgugcucaaagaaaaugaccggaaagagcauacaaccagaaaaccucgaguaccgcauaaugcucucaguccacggaagccagcacagcgggaugauagucaacgacacaggccacgaaacagacgaaaaucgagcaaagguagaaaucacaccgaacagcccccgcgccgaagccacgcuaggaggauucggcucccuaggacucgacugugaaccgcgcacaggacuagacuucuccgaccuauacuaccucacaaugaacaacaaacacuggcuagugcacaaggaaugguuccaugacauaccccuccccuggcacaccggagccgacaccggaacaccacacuggaacaacaaagaagcccugguagaguucaaagacgcacacgcaaaaagacaaacaguagugguccuaggcagucaagaaggcgcuguacacacagcacuagcaggagcacuagaagccgaaauggacggcgcaaaaggaagacugucgucaggacaccucaagugccgauuaaaaauggacaaacuaagacugaaaggagucucguacagccucuguaccgcggccuucacauucaccaagauaccagccgaaacacugcacggaacaguaacaguagaagugcaguacgccgggacggacggaccaugcaaagugccagcacaaauggccguagacaugcaaacacucacgccagucggccgccugaucaccgccaaccccgucauaacagaagggaccgagaacucgaaaaugaugcuggaguuggacccacccuucggagacagcuacaucguaaucggagugggcgagaaaaagauaacgcaccacuggcaccgcaguggaagcaccaucggcaaagccuucgaagccaccguccgcggcgcaaagagaauggcaguccuaggcgacacagcaugggacuucggaagcguaggaggcguucugaacagccuaggcaaaggaauccaccaaaucuucggcgcagccuucaaaucacucuucgggggcaugucaugguucagccaaauacuaauaggcacccuacucauguggcucgggcuaaacacuaaaaacggaagcaucagccuaaugugccucgcccugggaggcguacuaaucuuccuaagcacagcaguuucagccgacgugggaugcagcgucgacuucucaaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7307 - RNA, 2524 nt, Artificial Sequence
  KU744693.1 prME-long mRNA Design 2 opt
ggggcgcugccuacggagguggcagccaucuccuucucggcaucaagcuuaccaugcgaauaauuaacgcuagaaaagaaaagaaaagacgaggagccgauacauccguagggauugucggacuacuccuaacaacagcgauggcggcagaagugacacggcguggcagcgccuacuacauguaccuggaccgaaacgacgcaggcgaagccaucucauucccaacaacacuuggcaugaauaaaugcuacauccaaauaauggaucuaggccacaugugcgacgcgacaaugagcuacgaaugcccaaugcuagacgaaggcgucgaacccgacgacguggacugcuggugcaacaccaccuccaccugggucguguacgggaccugccaccacaagaaaggagaagcccgacgcucaagacgcgcgguaacacuaccaucacacucaacccgaaaacugcaaacccgcagucagaccuggcucgagucgcgagaauacacaaaacaccugauacgaguagaaaauuggaucuuccgaaacccgggauucgcccucgccgccgccgcaaucgccuggcuccuaggauccuccacaagccaaaaagucaucuaccucguaaugauccuccuaaucgcaccagccuacagcauaagaugcauaggaguaagcaauagagacuucgucgaaggaaugucaggcggcacauggguagacgucguacuagagcacggaggaugcgucaccgcaauggcccaagacaaaccaacaguagacaucgaauuagucacaacaacaguguccaacauggcagaaguacgcucauacugcuacgaagccagcaucagcgacauggcgagcgacucccggugccccacgcaaggcgaagccuaucucgacaaacagucagacacccaauacgucugcaaacgaacuuuaguugaccgcggcuggggcaacggaugcggccucuucggcaaaggaucacucgucacgugcgcgaaauucgccugcagcaagaaaaugacagggaaaucaauucagccugaaaaccuagaauaccgcaucauguuaagcguccacggaucacagcacuccggcaugcucgugaaugauacaggccacgaaaccgacgaaaauagagcgaaagucgaaaucaccccgaacucuccacgggcagaagcaacacuaggcggcuucggcucccucggacucgauugcgagccccgcaccggacucgacuuuagugaccucuacuaccucacaaugaacaacaaacacuggcucgcacacaaagaaugguuccacgacaucccgcuacccuggcacgccggagcagccaccggcacaccccauuggaauaacaaagaagcacucgucgaguucaaagacgcacacgcgaaacgccaaacagucguagucuuaggaagucaggaaggcgccguccacaccgcucucgccggcgcccucgaagccgaaauggacggcgccaaaggccgacucuccagcgggcaccuaaaaugccgacucaaaauggacaaacucagacucaaaggcguaucauacagccucugcacagcagcauucaccuucacaaaaauccccgcugaaaccguugacggcacaguaaccguagaaggccaauacgggggcaccgacggccccugcaaaguccccgcgcaaauggcgguagacaugcaaacccucacgcccguaggccgccucauaacagccaaccccgugaucacagaaucaacggaaaacagcaaaaugaugcuagaacuggaucccccauucggagacucauacauagugaucggugucggagaaaagaaaaucacccaccacuggcaccgcucaggcucaacaauuggaaaagccuucgaagcaacagucagaggcgcaaaacgcauggccguccugggagacacagccugggacuucggcucagugggcggcgcccucaacucccucgggaaaggcauccaccagaucaucggagcggccuucaaaagccuauucggcggaaugucaugguucagccaaauacuaauaggaacacuacuaauguggcuaggacucaacaccaaaaacggcaguaucucacucaugugccuagcccucggcggagucuuaaucuuccucucaacagcuguaucaggcgggguaggcugcuccguagacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7308 - RNA, 2524 nt, Artificial Sequence
  KY328290.1 prME-long mRNA Design 2 opt
ggggcgcugccuacggagguggcagccaucuccuucucggcaucaagcuuaccaugcgaaucauaaacgcacgcaaagaaaagaaacgacgagggacggacaccuccgucggaaucguaggccuccuucugaccaccgcaauggccgccgaagucacccgccgaggcucugcauacuacauguaccucgaccgcagcgaugccggagaagcgaucucauuccccacaacacucggcaugaacaaaugcuacauucaaaucauggaccucggacacaugugcgacgccacaauguccuacgaaugccccaugcuagaugaaggcgucgaaccagacgaugucgacugcuggugcaauacaaccagcaccugggucguguacggcacaugccaccacaagaaaggggaagccagacgcagccgacgagcagucacacuaccgucacacagcacacguaaacuccaaacccgcagccaaacauggcuggaguccagagaguacaccaaacaccugauaaggguagaaaacuggauauuccgcaacccuggcuucgcccucgccgccgcagcaaucgccuggcuacucggcucaucgaccucccaaaaaguaaucuaccucgucaugauacuucucaucgcccccgcauacuccauccgaugcauaggaguguccaaccgcgacuucguggaaggcauguccggcggaaccugggucgacguaguacuagaacacggaggaugcguaacggucauggcacaagacaaacccacaguugauauagagcucguaaccaccaccgucagcaacauggccgaaguacgcucauacugcuacgaagccuccaucucggacauggcuagcgauucccgcugccccacacaaggagaagcguaccuggacaaacaaucggacacacaauacguaugcaaacggacccuagucgaccgcgguuggggcaacggcugcggacuuuucggaaaaggaagccucguaacaugcgccaaauucgcaugcucgaaaaagaugaccggcaaaagcauacaaccagagaaccucgaguacagaauaaugcucucaguccacggcucccagcacuccggcaugauugugaaugacacgggccacgaaaccgacgagaaucgcgcuaaggucgaaaucacacccaauucaccacgcgcggaggccacacucggcggguuuggaagccucggccucgacugcgaacccagaacaggacuagacuucagcgaccuguacuaccucaccaugaacaauaaacacuggcuaguccacaaagaaugguuccacgacauccccuuaccauggcaugcaggcgccgacaccggcacaccccacuggaacaacaaagaagcccucguagaguucaaagacgcacacgccaaacgacaaacaguagugguacugggaucucaggaaggagccguacacacagcccuagcaggcgcauuagaagccgaaauggacggagccaaaggucgccucucuagcggacaucucaagugccgccugaaaauggacaaacucagacuaaagggagucucuuacucauuaugcaccgcagccuucacauuuuccaagaucccagccgaaacacugcacggcaccgucaccgaggaaguacaguacgccggaaccgacggcccaugcaagguaccagcccaaauggcggucgacaugcaaacacuaacccccgucggccgacucauuacagcuaaccccguuaucacagaaucaaccgaaaacucgaaaaugaugcuagaacuagacccacccuucggagacuccuacaucgucaucggcguaggcgaaaagaaaauuacacaccacuggcaccgcaguggcagcacgauaggaaaagcauucgaagcaacuguccgcggagccaaacgcauggcaguccucggggacaccgcaugggacuucggaagcgucggaggcgcccucaacucgcucggaaaaggaauccaccaaauuuucggagcagcguucaagucccuguucgggggcaugagcugguucagccaaauacucauaggaacacuacucaugugguuaggcuuaaacacuaagaauggcagcaucagccucaugugccucgcccuaggcggaguacucaucuuccucagcacagccgugagcgccgacguaggcugcagcgucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7309 - RNA, 2524 nt, Artificial Sequence
  KX694532.2 prME-long mRNA Design 2 opt
ggggcgcugccuacggagguggcagccaucuccuucucggcaucaagcuuaccaugcgcauaaucaacgcccggaaagaaaagaaacgacgaggcacugacaccuccgucggaauagucggacuacuacuaacuacagccauggccgcagaagucacaaggcgcggaucagcauacuacauguaccuagaccgcucagacgccggcgaagccaucagcuucccaaccacacuaggaaugaacaaaugcuacauacagauaauggaccugggacacaugugcgacgccacaaugagcuacgaaugcccaaugcuagacgaaggcguugaacccgacgacguagacugcugguguaacacgaccagcaccugggucguauacggaacaugccaccacaagaaaggcgaagcuaggcgcucccgacgcgccgucacccuaccgagccauuccaccagaaaacuccaaacgaggucccagaccuggcuggaaucccgagaauacacaaaacaccuuauacgaguagaaaacuggauauuccgaaacccgggguucgcccuggccgccgcugccauagccuggcuccucggcuccuccacaagccaaaaaguaauauaccugguaaugauccuacuaauagcccccgccuacagcaucaggugcaucggcgucucaaacagagacuucgucgaaggcauguccggcggaaccuggguggacguaguccuggagcauggcggaugcgugacaguaauggcccaagacaagccaaccguagacaucgaacugguaacuacaaccgucagcaacauggccgaaguccgaagcuacugcuacgaagccagcauaagcgacauggccuccgacucccggugcccaacacaaggcgaagccuaccuagacaaacaauccgacacgcaauacguaugcaaacgaacccuagucgacagaggauggggcaacggcugcggccucuucggcaaaggaucacucgucacgugcgccaaguucgccugcaguaagaaaaugacaggcaaaucgauacaacccgaaaaccuagaauaccgcaucaugcuaagcguacacggcagccaacacucaggaaugaucgugaacgacacaggccacgaaacagacgaaaaucgagcaaaaguagaaaucaccccuaacagcccacgugccgaagcaacacuaggaggauucggcagccuaggccuugacugugagccacgaaccggacucgacuucuccgaccuguacuaccucacgaugaauaacaaacauugguuaguccacaaagaaugguuccacgacauaccauugccauggcacgcaggcgcggauaccggaacgccacacuggaacaacaaagaagcacucgucgaguucaaagaugcacacgcaaaaagacagaccguagucguacuuggcagucaagaaggcgccguccacaccgcgcuugccggagcccuagaagccgaaauggacggcgccaaaggccgacucuccuccggacaccucaaaugccgacugaaaauggacaaacuccgacucaaaggcguaagcuacagcuugugcaccgccgccuucacauucacaaaaauaccagcagaaacucuccacggcaccguaaccguagaaguacaguacgccgggacagacggccccugcaagguaccagcacaaauggccgucgacaugcaaacccuaacacccguuggcagacuaaucacagcgaacccaguaaucaccgaaagcaccgaaaauagcaagaugaugcucgaacucgaucccccauucggcgacagcuacauagucauaggagucggcgagaagaaaaucacccaccacuggcaccgaagcggcagcaccauaggaaaagccuucgaagccacagugagaggcgcgaaaagaauggcaguccucggcgacacagcgugggacuucggcagcgucggcggcgcacucaacucacucggcaaaggcauccaccaaaucuucggcgcagccuucaaaagccucuucggcggcauguccugguucagccaaauacuaaucgggacccuacugauguggcuaggacuaaacaccaaaaacggaucgaucucccucaugugcuuagcacucggcggcguccuaauauucuuaagcaccgccguauccgcagacgugggcugcagugucgacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7310 - RNA, 2524 nt, Artificial Sequence
  KU955593.1 prME-long mRNA Design 2 opt
ggggcgcugccuacggagguggcagccaucuccuucucggcaucaagcuuaccaugcgaauaaucaacgcacgcaaagagaaaaagagaagaggaacagacacaucagucggcaucgucggauuacugcucacgacggcaauggcgguagaggugacccgcaggggaaacgccuacuacauguaccuagacagaagcgacgcaggagaggcuaucuccuucccgaccacaaugggcaugaacaaaugcuacauccaaaucauggaccuagggcauaugugcgacgcaaccaugagcuacgaaugcccaauguuagacgagggagucgaaccagacgacguugacuguuggugcaauaccacaagcaccugggucguauacggcacaugccaccacaagaaaggggaagcgaggcgcagucgacgcgccgucacccuacccagccauuccacacgcaaguuacaaacgcgcagccaaacguggcuagaaagccgagaauacaccaaacacuuaaucagagucgaaaacuggaucuucagaaacccgggauucgcacuagcagccgccgcgaucgccuggcuacuagguucgagcacaagccaaaaagucaucuaccuagugaugauacuccuaauagcccccgcauacagcauacgguguauaggcguaucaaacagagauuucgucgagggaauguccggcggaacauggguagacguaguacuggaacacggcggaugcguaacagucauggcacaggacaaacccacagucgacauagaacucgucaccaccaccgucagcaacauggccgaaguacgcagcuacugcuacgaggcaucaauauccgacauggcauccgacagcagaugcccaacgcagggagaggccuaccuagacaaacaauccgacacacaguacgugugcaaaagaacccuaguagaccgagguuggggcaacggcugcggacuauucgggaaaggcucgcuaguaaccugcgccaaauucgccugcagcaagaaaaugaccggcaaaucaauucaaccagaaaaccucgaauaccgaaucaugcucagcguccacggaagccaacacagcggaaugauaguaaacgacaccggccacgaaacagacgagaacagagcgaaagucgaaauaacacccaacaguccccgcgcagaagccacccugggaggauucggcagccucggccuagacugcgaaccacgaacaggacuagacuucagcgaccuguacuaccugacaaugaacaacaaacauuggcuaguacacaaagaaugguuccacgacauaccacucccuuggcacgcuggcgccgacacaggaacaccccacuggaacaacaaagaagcccuagucgaguucaaagaugcacacgcaaaacgccaaaccguagugguccugggcucacaggaaggagccgugcacacagccuuagcgggcgcgcucgaagccgaaauggacggagccaaaggcagauuaagcagcggacaccucaaaugccggcugaaaauggacaaacugcgacucaaaggaguauccuacagccucuguacagcggccuuuacauucacaaaaauaccagcggaaacgcuucacgggacaguaacaguugaaguacaauacgcuggaacagacggacccugcaaaguaccggcacagauggccgucgacaugcaaacccuaaccccaguaggacgccugauaacggccaacccagugaucaccgaaagcaccgaaaacucaaaaaugaugcucgaacucgacccgccauucggcgacagcuacauagucauaggagugggagaaaagaaaauaacgcaccacuggcaccgcagcggcaguacaaucggaaaagccuucgaagcaaccgugcgcggcgcaaaaagaauggccguacuaggagacaccgcuugggacuucggcagcguaggcggagcccucaacagccucgggaaggggauccaccaaaucuucggagcagccuucaagagccuuuucggaggcauguccugguucagccagauacuaauagggacccuacugguauggcuaggucucaacaccaaaaacggcagcauaagucuuaugugccucgcacuaggcggaguacuaauauuccuaagcacagcagugagugccgacguaggcugcagcguagacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7311 - RNA, 2524 nt, Artificial Sequence
  KY272987.1 prME-long mRNA Design 2 opt
ggggcgcugccuacggagguggcagccaucuccuucucggcaucaagcuuaccaugcgaaucauaaacgcccgcaaagaaaagaaaaggagaggcacagacacaagcguaggaaucguggggcuccugcuaacaacagccauggcggccgaggucacccguagaggcagcgcguacuacauguaccuagaccgcagcgacgccggagaggccaucagcuucccgacaacccuaggcaugaacaaaugcuacauacaaauaauggaccucggccacaugugcgacgcgaccaugucauacgaaugcccaaugcuggacgaaggagucgaacccgacgacguagacugcuggugcaacacaacgagcacguggguagucuacggaaccugccaccacaagaaaggcgaagcacgacgaucccgacgagcggucacgcucccaagccacuccacccgaaaacuccagaccagaagccaaaccuggcuagaauccagggaauacaccaaacaccucauccgcguagaaaacuggauauuccgaaaccccggcuucgcacucgcagcagcagccauagcauggcuacucggcagcagcacaagccaaaaaguaauauaccuggugaugauacuacugaucgcccccgccuacagcauccgcugcauuggagucaguaacagagacuucguagagggcaugaguggaggaacauggguggacgucguccuggaacacggaggaugcgucacaguaauggcacaagacaaacccacagucgacaucgaacucguuacaacgaccgucucaaacauggccgaaguacgcagcuacugcuacgaggcaaguauaagcgacauggcaagcgacagccgaugcccgacccaaggagaagcauaccuggauaaacaaagcgacacgcaauacgucugcaaaagaacccuagucgaccgcggaugggggaacggaugcggacuauucggaaaagggagccucguaacaugcgcaaaauucgcgugcucaaagaaaaugacaggcaaaagcauccaaccagaaaaccuagaauaccgaaucaugcuaagcguacacggaucccaacacagcggaaugauagucaaugacacgggacaugaaacagacgaaaacagagccaaagucgaaauaacaccaaacaguccccgcgcggaagccacccucgggggauucggaagccucggcuuagacugcgagccgcgcacaggacuagacuucagcgaccuauacuacuuaaccaugaauaacaaacauuggcucguccacaaagagugguuccacgacaucccacuuccguggcacgccggcgcggacacaggcacaccgcacuggaacaacaaagaagcccucguggaguucaaagacgcccacgccaaacgacaaacagucguaguucuagggucccaagaaggcgcaguacacaccgcacucgcaggcgcccucgaggccgaaauggacggcgccaaaggccgacuguccagcggacaccucaagugcagacuaaaaauggacaagcuccgccuaaaaggcguaucauacucgcuauguacagcggcauucacauucaccaaaaucccagccgaaacccuccacggaaccguaacaguagaaguacaauacgcaggaacagacggcccgugcaaaguaccggcccaaauggcaguagacaugcaaacacucacacccgucggaaggcuaaucacagcaaacccagucauaacggaaagcacagaaaacagcaaaaugaugcucgaacuagacccaccguucggcgacagcuacauaguuauagggguaggagaaaagaaaauaacacaccauuggcauagauccggcagcacaaucgggaaagcauucgaagcgacagucagaggagcuaaacgaauggccguacucggcgacacagccugggacuucggauccgugggcggggcccugaacagucucggcaaaggaauccaccaaaucuucggagccgcauucaaaucgcuauucggcggcauguccugguucucccagauccuaaucggaacccuauuaauguggcucgggcuaaacaccaaaaacggauccauuucccugguaugccucgcccucggaggaguacucauauuccugagcacagccgucagcgccgauguaggaugcuccguggacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7312 - RNA, 2524 nt, Artificial Sequence
  EU545988.1 prME-long mRNA Design 2 opt
ggggcgcugccuacggagguggcagccaucuccuucucggcaucaagcuuaccaugcgcauaaucaacgcaagaaaagaaaagaaacgccgaggcacagacaccagcgugggcauagucggacuacuccuaacaaccgccauggccguugaagucacacgacgaggaagcgcauacuacauguaccuagaccguagcgacgccggagaagcaauauccuucccaaccacccuaggaaugaacaaaugcuacauccaaauaauggaccuaggccauaugugcgacgcuacgaugaguuacgaaugccccaugcuggacgaaggcguagagccggacgacgucgacugcuggugcaacaccaccagcaccuggguagucuacggaaccugccaccacaagaaaggcgaggcacgcagaagccgccgagcagucacccuaccaucccacucaacacgcaaacuacaaacaagaucccaaaccuggcuggaaagccgcgaauacacaaaacaccugauacgagucgagaacuggaucuuccgaaacccaggcuucgcccucgccgcagccgccaucgcguggcuacucggcagcuccacuagccaaaaagugauauacuuaguaaugauacuccucaucgccccagccuacucgauccgcugcaucggcgucagcaauagggauuuuguagaaggcaugagcggcgguacuugggucgacgucgugcuagagcacggcggcugcgucacaguaauggcacaagacaaacccgccgucgacaucgaacucguaacgacgacaguaucaaacauggccgaagucagaucguauugcuacgaagccuccaucagcgacauggccagcgacucccgcugcccaacacagggagaagcauacuuagacaaacaaagcgacacacaauacguaugcaaacgaacccuagucgaccgcggaugggggaacgggugcggucuauucggaaaaggaucacucguaaccugcgccaaauucgcgugcagcaagaaaaugaccggcaaaucgauacaaccagaaaaccucgaauacagaaucaugcuauccguccacggcucccaacacucuggcaugaucguaaacgauaccggccacgaaaccgacgaaaaccgagccaaaguggaaaucaccccgaacagcccucgggcagaagccacgcugggcggguucgggagccuaggacucgacugugaaccacgcaccggacuagauuucagcgaccuauacuaccugaccaugaacaacaaacacugguuaguccacaaagaaugguuccacgacauaccacucccauggcacgcaggcgccgacacaggcaccccacacuggaacaacaaagaagcacugguagaguucaaagacgcccacgccaaacgccaaacggucguagugcuagggucacaggaaggcgcgguccacaccgcccucgccggcgcccuggaagcagaaauggacggugccaaaggacgccucagcucaggacaccuaaaaugccgacucaaaauggacaaacugcgccucaaaggggucucauacucacuaugcaccgccgccuucaccuucaccaaaaucccagccgaaacacuccacggaacaguaaccguggaaguccaguacgccggcaccgacggacccugcaaggugccagcacaaauggccguagacaugcaaacccucaccccagucggacgccuaauaacugccaaccccgucaucaccgaaagcacagaaaacucaaaaaugaugcuugaacuggaucccccauuuggcgacagcuacaucgucaucgggguuggcgaaaagaaaaucacacaccacuggcaucgcucaggcuccaccaucggcaaagcguucgaagccaccguccgcggcgcaaaacgcauggccguacugggagacaccgcaugggacuuuggaagugucggaggcgcccugaacucacuagggaaaggaauacaccaaaucuucggagcagcguucaaaagccucuucggcggaaugaguugguucagccaaauccuuauaggaacccuccucguauggcucggguuaaacaccaaaaacgggagcauuagccuuacaugccuagcccucggcggcguacucauauuccucagcaccgcugucucggccgacgucggcuguuccguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7313 - RNA, 2524 nt, Artificial Sequence
  KU681082.3 prME-long mRNA Design 2 opt
ggggcgcugccuacggagguggcagccaucuccuucucggcaucaagcuuaccaugcggaucaucaacgccagaaaagaaaagaaacggcgcggagcggacacaucagucgggaucguaggccuacuucucaccacggcaauggcagucgaaguaacaagacgcggaagcgccuacuauauguaccucgaccgcuccgacgccggagaagcaaucagcuuccccacuacccuaggcaugaacaaaugcuacauccaaaucauggaccucggacacaugugugacgccacgaugucauacgaaugccccaugcucgacgaaggaguggaacccgacgacguagacugcuggugcaacaccacaucaacauggguugucuacggaaccugccaccacaagaaaggagaagcccgucgaagccggcgagccguaacacucccuucgcacucaacccgaaaacugcaaacaagaucccaaacauggcuagaaagucgugaauacacaaaacaucuaauacguguggagaacuggaucuuccgaaaccccggauucgcauuagcagccgccgucauagccuggcugcuaggaagcagcaccagccaaaaaguaauauaccuggucaugauccuacucauagcgccagccuacuccaucagauguauaggcgucucaaaccgggacuucgucgagggaauguccggaggcacuugggucgacgugguacuggaacacggcggaugcgucacagucauggcacaagacaaaccaacuguagacauagaacucgucacgaccacggucagcaacauggccgaggucagaagcuacugcuacgaagccagcauuucagacauggcaagcgacagccggugcccgacccaaggagaagcguaccuagacaagcaaagcgacacccaauacgucugcaaaagaacccucgucgaccggggcuggggcaacggcugcggacucuucggcaaaggaagucuaguaacuugcgcaaaauuugcgugcucgaagaaaaugaccggcaaaucaauccaacccgagaaccuagaguacagaauaaugcuaucaguucacggcagucagcacuccggaaugaucguaaacgacaccggccacgaaaccgacgaaaaccgcgcaaaagucgaaauaacacccaacagcccccgagccgaagccacacucggaggguucggcucccuaggacuagacugcgagccacgcaccggacucgacuucucagaccuauacuaccuaaccaugaacaacaaacacuggcucguccacaaagaaugguuccacgacauaccgcuccccuggcacgccggagcggacaccggcacaccccacuggaacaacaaagaagcccuagucgaguucaaagacgcacaugcaaaacgccaaaccguagucguacucggcagccaggaaggggccgugcacacagcccuagcaggagcccucgaagccgaaauggacggagccaaaggacgacucucaagcggccaccucaaaugccgacuaaaaauggacaaacuacgacuaaaaggcgucagcuauagccugugcaccgcagccuuuaccuuuacuaagauucccgcggaaacccuacauggcaccgucaccguagagguacaauacgccggcaccgacggcccaugcaaaguccccgcccaaauggccgucgacaugcaaacgcucacaccagucggaagacuaauaacagccaaccccgucaucaccgaaaguaccgaaaacaguaaaaugaugcuagaacucgauccacccuucggagacucauacaucgucaucggagucggcgaaaagaaaauaacacaccauuggcauaggucgggcuccacaauaggaaaagcauucgaagccaccguccgcggugcaaaacgaauggcaguccuaggggacacagcaugggacuucggcagcgucggaggugcacuaaacucccucggcaaaggcauccaccaaaucuucggcgcagccuucaaaucccuguucggaggcauguccugguucagccaaauccucaucggcacccuauuaguauggcuaggccucaacacgaaaaauggcucgauaucacuaacaugucucgcccuaggcggaguccucaucuuccuaagcaccgccguauccgcagacgucggaugcuccguagacuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7314 - RNA, 2524 nt, Artificial Sequence
  KX601167.1 prME-long mRNA Design 2 opt
ggggcgcugccuacggagguggcagccaucuccuucucggcaucaagcuuaccaugcgaauuauaaacgcccgcaaagagaagaaaagacgcggagccgacacauccguggguaucgucggacuccuccuaaccaccgccauggccgucgaaguaacccgacgcggauccgcguacuacauguaccuugaccgcucagacgcgggggaagccauaucuuuucccaccacacuaggagucaacaaaugcuacauccaaaucauggaccuaggccacaugugcgacgccacaaugagcuacgagugccccaugcucgacgaagggguugaaccagacgacguugacugcuggugcaacaccacguccaccuggguugucuauggaaccugccaccacaagaaaggcgaagcccgccggucccgccgagccgucacccugcccagccacagcacacgcaaacuacaaacccgaucucaaacauggcuagagucacgagaauauacaaaacaccucauccgagucgaaaauuggaucuuccgcaacccaggcuucgcgcucgccgcagccgccaucgcauggcuccucggauccucaaccucacaaaaaguuauauaccugguaaugauauuacucauagcaccagccuacucaauacgaugcauaggagucuccaaccgcgacuucgucgagggcaugagcggaggcaccuggguagacgucguccuagaacacggaggcuguguuaccgucauggcgcaagacaaacccacagucgacaucgaacucguaacaaccaccgucuccaauauggcggagguacgaucauauuguuacgaagcaucaauaucagacauggcgagcgacagucgcugcccgacccaaggcgaagccuaucuugacaaacaaagcgacacacaguacguaugcaaacgaacacucguagaccgaggcuggggcaacggcuguggccuguuuggcaaagguagccugguaacaugcgcaaaauucgccugcuccaagaaaaugaccggcaaaucaauacaacccgaaaaccuagaauaccgcaucaugcuguccguccacggcagccaacacagcggcaugaucgucaacgacaccggacacgaaaccgacgaaaaccgcgccaaaguagagauaacaccuaacucaccccgagccgaagccacacucggaggcuuuggcagccuaggacucgacugcgaaccccgaacaggacucgacuucuccgaccuauauuaccuaacaaugaacaacaaacacuggcuaguacacaaagaaugguuccacgacauaccacuacccuggcacgccggagccgacaccggaacaccccacuggaacaacaaagaagcacucgucgaguucaaggacgcacacgccaaacggcagaccgucguuguccuaggcucacaagaaggcgcgguccacaccgcucucgcaggcgcccucgaagcagaaauggacggcgccaaggggaggcucuccuccggacaccucaagugccgccuaaaaauggacaaacuacggcucaaaggaguaagcuacagccucugcacagcagcauucacauucaccaaaauaccagcagaaacgcuacauggaacagucacggucgaaguacaauacgcgggcacagacggacccugcaaagugcccgcacaaauggcgguugacaugcaaacccuuacgccagucggccgacucaucaccgccaaccccgucauuacagaauccacagaaaacuccaaaaugaugcuugaacuggacccacccuucggcgacucguacauaguaauaggcgucggcgacaagaaaaucacccaccacugguaccgcuccggcucaacaaucggaaaagcauucgaagcaaccguccgaggugccaaacguauggcaguacuaggcgacaccgccugggacuucggcuccguaggaggagcacucaacucccucggaaaaggaauccaucaaauauucggagccgccuucaagucccuauucggcggcaugucaugguuuagccagauccucauaggaacccugcuaguauggcuaggccucaacaccaaaaacgggucaaucucuuuaaccugccuagcauuagggggaguucucauauuccucagcacagcaguaagcgccgacguaggcuguuccgucgauuucucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7315 - RNA, 2524 nt, Artificial Sequence
  KX694533.2 prME-long mRNA Design 2 opt
ggggcgcugccuacggagguggcagccaucuccuucucggcaucaagcuuaccaugcgcauaaucaacgcacgcaaagaaaagaaaagacgcggagcagacacaagcgugggaauuguaggccugcuauuaaccacugccauggcgguagaaguaacacgacgcggaucagcauacuacauguaccuggacagaagcgacgcuggcaaagccaucuccuucccaacaacgcugggaguaaacaaaugcuacauccaaauaauggaccuagggcacaugugcgacgccacaaugagcuacgaaugcccgaugcucgacgagggaguagaaccagacgacgucgacugcuggugcaacacaacuagcacauggguaguauacggcaccugucaccacaagaaaggagaagcacgccggagccgacgggcagucacgcuacccucacacagcacacgaaaacuacaaacucgcucccaaaccuggcucgaaagccgagaauacaccaaacaccuaauccgcgucgagaacuggaucuuccgcaacccaggauucgcacuagcagcugcagcaaucgcguggcugcucggaagcagcacaagccaaaaaguaauauaccuaguaaugauacuccucaucgcccccgccuauaguauacggugcaucggcgucagcaaccgagacuucgucgaaggcaugagcggcggcacgugggucgacgucguccucgaacauggcggaugcgucacaguaauggcccaggacaaaccaaccgucgacaucgaacuugucacaacgaccgugagcaacauggccgaaguccgcuccuacugcuaugaagccuccaucucagauauggccucagacagccgaugcccaacccagggcgaggcauacuuggacaaacaaagcgacacccaauacgucugcaagcgaacacuggucgaccgagggugggguaauggaugcggccuauucggcaagggaagccuagucaccugugcaaaguucgccugcucaaagaaaaugacagggaaauccauccaacccgaaaaccucgaguaccgcauaauguugagcguccacggcucccaacacagcggcaugauaguaaacgacaucggccaugaaaccgacgaaaaucgagcaaaaguagaaauaacaccuaacaguccgagagcggaagcaacacuaggaggcuucggcucgcuaggccuagacugcgaaccccgaaccggacucgacuucagcgaccuauacuaucucacuaugaacaacaaacacuggcucgugcacaaagagugguuccacgacaucccgcuccccuggcacgcaggagccgacacaggcaccccacacuggaacaacaaagaagcgcuagucgaguucaaagacgcacacgcuaaaagacaaaccguggucguccuaggcucacaagaaggcgcaguacacacagcacuagccggcgcucucgaagcagaaauggacggagccaaaggucgacuauccuccggccaccuaaaaugccgccucaaaauggauaaacuccgccucaaaggcguaucauacagucuaugcaccgccgcauucacauucacaaaaauaccagccgaaacccuccacggcaccguaaccguagaaguacaguacgcaggaaccgacggaccaugcaaagugccagcccaaauggcagucgacaugcaaacacucacuccagucggacgacuaaucaccgcuaaccccgucauaaccgagagcacggaaaauuccaagaugaugcuagaacuggaucccccguucggcgacagcuacauagucaucggagucggagacaagaaaaucacacaccacuggcaccgaagcggcagcaccaucggaaaagcguucgaagcaaccgucagaggcgccaaacgaauggccguacucggagacacggccugggacuucggcuccgucggcggagcacucaauucccucggaaaagguauccaccaaauuuucggcgccgcauucaaaucacuauuugggggcauguccugguucucgcagauacuuaucggcacccuccuaguauggcuaggacuaaacaccaaaaacggcagcauaagccucacaugccuagcccucggagggguccuaauauuccugagcacagccguaagcgcugacgucggcugcagcgucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7316 - RNA, 2524 nt, Artificial Sequence
  KY288905.1 prME-long mRNA Design 2 opt
ggggcgcugccuacggagguggcagccaucuccuucucggcaucaagcuuaccaugagaaucaucaacgcaagaaaagaaagaaaaagaagaggcgccgacacaucaaucggcaucgucggccugcuacuaacaacagcuauggcagcagaaaucacccgacgaggcucagcguacuacauguaccucgacagaagcgacgccggaaaagcuaucagcuucgccacgacacugggagucaacaagugccacgugcagauaauggaucucggacacaugugcgacgcaaccaugaguuaugagugccccaugcuagacgaaggcguagagccagacgacguagacugcuggugcaacacaacaagcaccuggguaguauacggcacaugccaccacaagaaaggagaagcaagacgaagcaggcgcgcaguaacacuacccucacacagcacacgaaaacuccaaaccagaagccagacauggcucgagagccgugaauacacaaaacaccuaauaaaaguggaaaacuggauauuccgcaacccaggguucacccuaguagccguagcaaucgcguggcuucucgggagcagcaccucccagaaagucauauaccucguaaugauccuucucauagcuccggccuacagcauacgaugcauaggcguaagcaaccgcgacuucgucgaaggaaugucagggggaacauggguggacguaguacuagaacacggaggcugcgucacgguaauggcacaagacaaaccaaccgucgauaucgagcuagucaccaccacagucagcaacauggcggaaguacgaagcuacugcuacgaagccucaaucagcgacauggcgagcgacucucgcugcccaacacaaggcgaagcauaccucgauaaacaaagcgacacgcaguacgucugcaaacgcacccucgucgacagaggguggggcaacggguguggccuauuuggaaagggaucauuagucacaugcgcaaaauucacaugcagcaagaaaaugacagggaaaagcauccaaccugagaaccucgaauaccgcauaaugcucagcguccauggaucacaacacuccggcaugaucgucaacgacacgggacacgaaacagaugaaaaucgagcgaaaguagaggucacaccgaauagccccagagccgaagccacacuaggaggauucggaagccucggccuggacugcgaaccgcgaaccggccucgacuucagcgaccuauacuaccucaccaugaacaacaaacauuggcuaguccacaaagaaugguuccacgacaucccccuccccuggcacgcaggcgccgacacgggaaccccucacuggaacaacaaagaagcacugguugaguucaaagacgcacacgccaaaagacaaacaguaguaguauuagggagccaggaaggagccguacacacagcccucgcaggcgcccuagaagccgaaauggacggagccaaaggcagacuguucagugggcaccucaaaugcaggcuaaaaauggacaaacuacgccuaaaaggcguaagcuacagccuaugcacagccgcauucaccuucacaaagguccccgcggaaacacugcaugggacgguaacaguagaagugcaauacgcaggcacagauggacccugcaaaguaccagcacaaauggccguagacaugcaaacacuaacacccgucggaagacucaucaccgcaaacccagucaucacggaaucaacagaaaacagcaaaaugauguuagaacuggacccacccuucggcgacucauacauaguaauaggcgucggagacaagaaaaucacgcaucacuggcaccgcagcggcagcacaauuggcaaggcauucgaagcaacagucagaggagcgaaacgaauggcaguacucggcgauacagccugggacuuuggauccgugggaggcguguucaacagccucggaaaagguauccaccaaaucuucggcgcagcguucaaaucacuauucggcggcaugagcugguucagccaaauacucaucggaacacuccuaguauggcuaggacucaacaccaaaaacggcagcaucagccugacaugccuagcgcucggaggagucaugauauuccucucaaccgcagugucggccgacguagggugcagugucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7317 - RNA, 2524 nt, Artificial Sequence
  KF268950.1 prME-long mRNA Design 2 opt
ggggcgcugccuacggagguggcagccaucuccuucucggcaucaagcuuaccaugagaauaaucaacgcccgcaaagagcgcaaaagaaggggagcagacacgagcauaggcaucaucggacuccugcucaccaccgcaauggcagcagaaaucaccagaagaggaucagccuacuacauguaccuggacagaagcgacgcgggaaaagcaauauccuucgcaacgaaucuaggcgucaacaaaugccacguacagaucauggaccuaggucauaugugcgacgccaccaugucauacgaaugcccaaugcuagacgaaggcgucgaaccagacgacgucgacugcuggugcaacaccacguccaccugggugguauacggcacaugccaccacaagaaaggcgaagcccgaaggagcagacgcgcugucacccuaccaagccacaguacgcgcaagcuccaaacaagaagccagaccuggcuagaaagccgcgaauacacaaagcaccuaaucaaagucgaaaacuggaucuuccgaaacccaggauucgcccucgcagccgucgcaaucgcauggcugcuaggaagcuccaccagccaaaagguaaucuaccuggucaugauccuacugaucgcacccgccuacucgauucgaugcaucggcguaucgaaccgcgacuucgucgaagguaugagcggcggaaccugggucgacgucguacuagaacauggcggcugcguuacaguaauggcacaagauaagcccaccguagacaucgaacucgucaccacgaccguaagcaacauggcagaaguccgcucuuacugcuacgaagcaagcaucagcgacauggcaagcgacucacgauguccaacccaaggggaagcauaccucgacaagcaaagcgauacacaauacguaugcaaaaggacccucgucgaccgaggcuggggaaacggaugcggacucuucggcaaaggaagccuaguaacaugcgccaaauuuacaugcagcaagaaaaugacaggcaaaaguauccagccagaaaaccucgaauaccgcaucaugcuuagcguacacggcagccaacacucaggaaugaucgucaacgacauaggacacgaaaccgacgaaaacagggcgaaaguagaagucacacccaacuccccacgagcagaagcuacccugggcggauucgggagccugggccucgacugugaaccgagaacaggacuagacuucagcgaccucuacuaccucacaaugaacaacaaacacuggcuggugcacaaagaaugguuccaugacauaccgcucccauggcacgcaggagccgacacaggaacaccgcacuggaacaacaaagaagcccuagucgaguucaaagacgcacacgcgaaaaggcagacagucgucguccugggaucacaggaaggcgcaguacacacagcacucgccggcgcguuagaagcagagauggacggugccaaaggacgacuguuuucagggcaccucaaaugccggcuaaaaauggacaaacugcgccucaaaggaguaucauacagcuuaugcaccgccgccuuuaccuucaccaaaguccccgcagaaacccuccacggcaccguaacaguggaaguacaauacgcagggaccgacgggccaugcaagguaccugcacaaauggccgucgacaugcaaacacucacacccgucggaagacuaaucaccgccaacccaguaauaacagaaagcacagaaaacagcaaaaugaugcuagaacuagacccaccauuuggagacagcuacaucgugaucggagugggcgacaagaaaauaacccaucacuggcaccgcucaggcagcacaauaggcaaagccuucgaagcaacagucagaggagcgaaaagaauggccguacugggagacacugccugggacuucggcuccgucggcgggguauucaacagccuuggcaaaggcgugcaccagauauucggggccgcguucaaaaguuuauucgggggaaugaguugguucucccaaauacuaauaggcacacuucuaguauggcucggacuaaauacgaaaaacggaagcauuagccucacaugcuuagcccucggcggaguuaugauauuccucaguacagcagugucagccgacgugggaugcuccguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7318 - RNA, 2524 nt, Artificial Sequence
  KF383121.1 prME-long mRNA Design 2 opt
ggggcgcugccuacggagguggcagccaucuccuucucggcaucaagcuuaccaugcgcaucauaaacgcacgcaaagaaaggaaacgcagaggagcggacaccuccauaggaauaauaggccuacuacucacaaccgccauggcggccgaaaucacgcgacgaggaucugcguacuacauguaccuggaccgcagcgaugccggaaaagccaucuccuucgcaacgacgcucggagucaacaagugccauguacaaauaauggaccucggucacaugugcgacgccacgaugucauacgaaugcccgaugcucgacgaaggcguagaaccagacgacgucgauugcuggugcaacacaacgagcacaugggucguauacggcacuugccaccacaaaaagggagaagcacgccgcagccgccgagcagucacacugccaucccacagcacgcgcaaacuacaaaccaggagccaaacguggcuagaaagcagagaauacacgaaacaccugaucaaagucgaaaacuggauauuccgaaaccccggauucgcccugguagcaguagcaaucgcauggcuacuaggcuccagcacaucccaaaaggucauauaccuaguaaugauacuacucaucgcaccagccuacagcauaagaugcaucggcguaagcaaccgcgacuucgucgaaggaauguccggcgggaccuggguugacguaguacucgaacacggcggaugcgucaccgugauggcacaagacaaacccacgguagacaucgaacucgucacaacgacagucagcaacauggcggaagugcguucguacugcuacgaagccagcauaucagacauggcauccgacucaagaugcccaacacaaggcgaagccuacuuagacaaacaaucagacacccaauacgucugcaaacggacacuugucgaccgcggauggggaaacggaugcggacuauucggaaaaggcucgcuagugacaugcgcaaaguucacaugcucaaagaaaaugacaggcaaauccauacaaccagaaaaccuugaauaucgaauuaugcucagcguccacggcucccaacacucaggaaugauagucaacgacauaggacacgaaacagacgaaaacagagccaaaguggaggucacaccaaacucccccagagcagaagcaacacuaggaggauucggaucccugggacuagacugcgaacccaggacaggccuugacuucuccgaccucuacuaccucaccaugaacaacaaacacuggcucguccacaaagaaugguuccacgacauaccccugcccuggcaugccggggcagacacagggacaccccacuggaacaacaaagaggcucugguagaguucaaagacgcgcacgcgaaaagacaaacagucgucguccucggcucccaggaaggcgccguacauacagcacucgcuggcgcgcuagaagccgaaauggacggcgcaaaaggcagacucuucuccggacaccuaaaaugccgacucaaaauggacaaacuacgacugaaaggcguauccuacagccuauguacagcagcauucaccuucacuaaaguaccagccgaaacccuacacggcacaguaaccguagaaguccaguacgcaggaacagacggccccugcaaaguaccagcacagauggcagucgacaugcaaacgcugaccccgguagggaggcucauaaccgccaacccaguuaucacggaaucaaccgaaaacagcaaaaugaugcucgaacuggacccacccuucggcgauucauacauaguaauaggaguaggcgacaagaaaauaacccaccacuggcacagauccggcagcaccauaggcaaagccuucgaggccacaguacgcggcgccaaaagaauggccguacucggagacaccgcaugggacuucggauccgucggaggcguauucaacagccucggcaaaggaauccaccaaauauucggagccgccuucaaaagccuauucggaggcaugagcugguucagccaaauccuaaucgggacgcuccuaguauggcuaggccucaacaccaaaaacggaagcaucagccuaaccugucuagcccugggcggcguaaugaucuuccuaagcaccgcggucagcgccgacguaggcugcagcguugacuuuucaaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7319 - RNA, 2506 nt, Artificial Sequence
  KF268949.1 prME-long mRNA Design 2 opt
ggggcgcugccuacggagguggcagccaucuccuucucggcaucaagcuuaccaugagaauaaucaacgcaaggaaggaaaggaaaaggaggggcgcagacacgagcauagggauaaucggccuacuacugacaacagcgauggccgccgaaauaaccaggaggggcagugcauacuacauguaccuggacagaagcgacgccgggaaagcgaucucguucgcgacuaaccucggcgucaacaagugccacgugcaaauaauggaccucggccacaugugcgacgcaaccaugucguacgaaugcccgaugcuagacgaaggaguggaacccgacgacguagacugcuggugcaacacaacgagcaccuggguaguauacggaaccugccaccacaagaaaggcgaagcgcgccggagccggcgagcggucacacucccaagccauagcacacgaaaacuccagacccgcagccagacauggcuagaaagcagagaauacacaaagcaccugaucaaagucgaaaacuggauauucagaaacccaggguucgcacuagcagcgguagccaucgccuggcugcuaggcagcuccacuagccagaaggucauauaccucguaaugaucuuacucaucgcgccagcauacucaauaaggugcaucggcgugagcaaccgcgacuucgucgaaggcaugucgggaggaaccugggucgacgucguccuagaacacggcggcugcgucacaguuauggcacaggacaagcccacaguagacauagaacucgucacaacaaccgugagcaacauggccgaaguacgaagcuacugcuaugaagcgucaaucucagacauggcaucagacagccgaugccccacacagggggaagcauaccucgacaagcaaagcgacacccaauacguauguaaacgaacccucgucgacagaggaugggggaacggauguggccuauucggaaaaggcagccucgugaccugcgcaaaauuuaccugcucaaagaaaaugacgggaaagagcauccaacccgaaaacuuagaauacagaaucaugcuauccguccauggaucccaacacagcggcaugauagucaacgacgaaaacagagccaaaguggaggucacgccaaacagcccaagagccgaagccacccucggcggauucggcagcuugggccuagauugcgaacccaggaccggacuagacuucuccgaucuuuauuaccugaccaugaacaacaaacacuggcuaguacacaaagaaugguuccacgacaucccacuaccauggcacgcaggagcagacacagggaccccgcacuggaauaauaaagaagccuuggucgaguucaaagacgcacacgcgaaacgccaaaccguaguaguacuaggcucccaagaaggugcgguccacaccgcucuagccggagcccucgaagcagaaauggacggcgccaaaggccgacuguucucaggccaccuaaaaugucgacuaaaaauggacaaauuacgccucaaaggcguaaguuacucgcucugcacagcggcauucaccuucaccaaagugccagccgaaacuuuacacggaaccguaaccgucgaaguacaauaugcgggaacagacggacccugcaaaguuccagcucaaauggcggucgacaugcagacgcucacccccgucggccgacucauaaccgccaaccccgucauaacugaaagcacagaaaacucaaagaugauguuagaauuagacccacccuucggcgacucauacaucguaauaggcguaggagacaagaaaauaacccaccacuggcaccgaucagguagcacgauagguaaagcauucgaagccacagucagaggcgcaaaacgcauggcagugcugggcgacacagcgugggacuucggauccgucggcggaguauucaacucacucgggaaagggauccaccaaauauucggagccgcauucaaaucccuauucggcggaaugagcugguucucccaaauacuaauaggcaccuuauugguauggcuagggcucaacaccaaaaacggaagcauaagccugaccugccuagcacucggaggagucaugauauuccucagcaccgcagucagcgcagacgucggaugcagcguggacuuuagcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7320 - RNA, 2524 nt, Artificial Sequence
  KU955595.1 prME-long mRNA Design 2 opt
ggggcgcugccuacggagguggcagccaucuccuucucggcaucaagcuuaccaugagaauuaucaacgcccgaaaagaacgcaagcggcgaggcgcagacaccucaauaggaaucgucggccuacuacuuaccacagcgauggcggcagaaaucacacgacgcggcagugcauacuauauguaccuagaccgcucagacgccggcaaagcaaucaguuucgcaaccacccucggcgucaacaagugccacguccaaauuauggaccuaggccacaugugcgacgccaccauguccuacgaaugccccaugcuugacgaaggagucgaacccgacgacgucgacuguuggugcaacaccacaagcaccugggucgucuacggcacaugucaccacaagaaaggcgaagcgcgaaggagcagacgagcgguaacccuaccaucccauuccacccguaaacuucaaacacgcagccaaaccuggcucgaaagccgagaauacacaaaacaccuaaucaaagucgaaaauuggauauuccgcaacccgggguucgcucuagucgccguggccauagccuggcuccuaggcuccucaacgucacaaaagguaauauaccucgucaugauacuccuaaucgcaccagcguacagcauccgaugcauaggcgucagcaaccgcgacuucguggaggggaugagcggaggcaccuggguagaugucguacucgaacauggaggcugcgucacagucauggcacaagacaagccaacaguggacauagaacucgucacaacgacgguuagcaacauggccgagguacgaagcuacugcuacgaggccagcauaucagacauggccagcgacucaaggugccccacccaaggggaagcauacuuggacaaacaauccgacacccaauacgucugcaaacggacccugguggaccgaggguggggcaacggcugcggccucuucggaaaagguucccucguuacaugcgccaaauuuacgugcagcaagaaaaugaccggaaaaucaauacaaccugaaaaccucgaauacagaauaaugcucagcguccacggcucgcaacacagcggaaugaucguaaacgacaccggacacgaaaccgacgaaaaccgcgccaaagucgaagucacaccaaacuccccacgcgccgaagccacacucggcggauucgguagccuaggacuggacugcgaaccacgcacaggacuagacuucuccgaccucuacuaccuaaccaugaacaacaaacacuggcucguccacaaagaaugguuccacgacauaccccucccauggcaugcgggcgccgacaccggcacaccccacuggaacaacaaagaagcucuaguagaguucaaagacgcacacgcuaaacgccaaaccgucguaguccuuggcucccaagaaggcgcuguacauaccgcccuagcuggugcccucgaagcagaaauggacggagccaaaggacgccuguucuccggccaccucaaaugccgccucaaaauggacaaacuccgccucaaaggaguaucauacucccuaugcaccgcagcuuucacguucacaaaagugccagccgaaacacuacacggaacagugaccgucgaaguccaauacgccggcaccgacggacccugcaaaguacccgcccagauggccguagacaugcagacccuuacccccgucggaagacuaaucaccgcaaacccagucaucaccgaaucaacagaaaauagcaaaaugaugcucgaauuagacccacccuucggcgacucauacaucgucauuggcguaggcgacaagaaaauaacccaccacuggcacaggucagguuccaccaucggcaaagcauucgaagccaccguacgaggcgccaaacgcauggcaguccuaggagacaccgcgugggacuucggcagcgugggaggaguuuucaacucccucggaaaaggaauccaccaaaucuuuggcgcggcauuuaaaagucuauuuggaggaaugagcugguucucacaaauucugauaggcacccuccucgucuggcuaggucuaaacaccaaaaacggcaguaucucacuaaccugccucgcacuaggagggguaaugaucuuccucaguaccgcagucuccgcagacguugggugcagcgucgacuucuccaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7321 - RNA, 2524 nt, Artificial Sequence
  KF383116.1 prME-long mRNA Design 2 opt
ggggcgcugccuacggagguggcagccaucuccuucucggcaucaagcuuaccaugcgaauaaucaacgcgaggaaagaacgaaagagacggggcgcggacacauccauaggcauaguagggcugcugcuaacaacggcgauggcagccgaaauaacaagaaggggaagcgccuacuacauguaucucgaccgaucggacgccgggaaagcaaucagcuucgcaaccacccucggaguuaacaaaugccacguacaaaucauggaccuaggccacaugugcgacgccacaaugagcuacgaaugcccaaugcuggacgaaggcguggaacccgacgacgucgacugcuggugcaacacgacaagcaccuggguggucuacggcacaugccagcacaagaagggggaagcccgacgauccagacgcgcggucacacugccaagccacuccacccgcaaacuacagacaaggagccaaaccuggcucgaaagccgagaauacaccaaacaucucauaaaaguagagaacuggauauuccgaaacccuggguucgcccucgucgcgguggcaaucgcauggcuacuaggauccagcacgagccaaaaagucauauaccuaguaaugauacucuuaaucgcgccagcauacucaauccgaugcauaggcgucuccaacagagauuucgucgaaggaauguccggcggcaccuggguagacgucgugcuagaacauggaggcugcguaacaguaauggcacaagacaaaccaacagucgacaucgagcucgugacaacaaccguaaguaacauggcggaagugcgcucguacuguuacgaagccagcaucucugacauggcaagcgauagcagaugcccaacgcaaggcgaagcguaccucgacaagcaauccgacacacaguauguaugcaagaggacauugguagacagagguugggguaacggaugcggacuguucggaaaaggcucgcuaguaaccugcgccaaauucacaugcaguaagaaaaugacaggcaaaagcauacagcccgagaaccucgaauacaggauaaugcucucagugcacggaagccaacacagcggaaugauaguaaacgacauuggccacgaaacugacgagaacagagcaaaaguagaagugacacccaacagcccaagggcggaggcaacacuaggcggauucggcagccuaggccuagacugugaaccgcgaacaggccucgacuucagcgaccuauacuacuuaaccaugaacaacaaacacugguuggugcauaaagagugguuccacgacauaccacuuccauggcacgccggagcagacacagggaccccacacuggaacaacaaagaagcacuggucgaguucaaagacgcgcacgccaaacgacagacaguagucguccugggaagucaagaaggcgcgguacacaccgcacucgcaggcgcccuagaagccgaaauggacggcgccaaaggaaggcuguucaguggccaccuaaaaugcaggcucaaaauggacaaacuucgacugaaagggguaagcuacucguugugcaccgccguaugcacagccgccaaaguacccgcggaaacacuacacggcacggugacaguggaaguccaguaugccgggaccgacggacccugcaaggucccagcccaaauggcaguagauaugcaaacccucacgcccguagggcgacuaauaaccgcaaacccaguaauaacagaaucgacagaaaacagcaaaaugaugcuggaacucgacccgcccuucggagacagcuauauaguaauaggggucggagacaagaaaauaacacaccacuggcaccggagcggaagcacaauugggaaagcauucgaagcgacagugcggggagcuaaaaggauggcgguacuaggagacaccgcaugggauuucgggagcgucggcgggguauucaacagccuagggaaaggcauacaucaaauauuuggcgcagcuuucaagagccuauucgggggcaugagcugguucucacaaauacuaauaggaacccuccuagucuggcucgggcucaacacaaagaauggaucaauaagccuaacaugccuugcucucggaggcgugaugauauuccuaucaacagcggugagcgcggacgugggaugcuccguagacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7322 - RNA, 2506 nt, Artificial Sequence
  KU963574.2 prME-long mRNA Design 2 opt
ggggcgcugccuacggagguggcagccaucuccuucucggcaucaagcuuaccaugcgaauaauaaacgcccgcaaggaaagaaaacgcaggggcgccgacgccucaauaggaaucgucucacuccuacucacaacagugauggccgcagagaucacgcgcagaggauccgcauacuacauguaccuagacagaagcgacgcaggaaaggcaauauccuucgucacaacccucggcgugaacaaaugccacguccaaauaauggaccuaggccacaugugcgacgccacaaugucauacgagugcccaaugcuggacgaaggcgucgaaccggacgacgucgacugcuggugcaacacaacguccacauggguagucuacggaaccugccaccacaagaaaggcgaagcacggaggagccggcgcgcaguaacauuaccaucacacaguacccgaaaacuccaaaccagaucccaaaccuggcuagagagccgcgaauacaccaaacaccuaaucaaaguggaaaacuggauauucagaaaucccggauucgcacucgucgccguagccaucgcauggcuacugggauccagcacaagccaaaaaguuaucuaccucguaaugauacuccugaucgcacccgcauacucaauaagaugcauaggcguaagcaaccgcgacuuuguagaaggaaugagcggagggacgugggucgacgucguacuagagcacggaggaugcgucaccgugauggcccaggacaaacccaccgucgacauugaacucgucacgaccacaguaagcaacauggccgaaguacggucauacugcuacgaagccucaauaagcgacauggcaucagacucacgcugcccaacacaaggggaagccuaccuagauaagcaauccgacacccaauacguaugcaaacgcacccuagucgaccgcggaugggggaacggaugcggacuauucggcaaaggaucgcuggugaccugcgccaaauucacaugcucaaagaaaaugaccgggaaaagcauccaaccagaaaaccucgaauaccguauaaugcuaucaguccacggcucucaacauucaggcaugaucgucaacgacgagaaccgcgcaaaaguagaggugacccccaacuccccaagagcagaggcgacccucggaggauucggcucacugggccuagacugcgaaccccgcaccggcuuagacuucagcgaccucuacuaccuaaccaugaacaacaaacacuggcuaguacacaaagaaugguuccacgacauaccacuucccuggcauucaggggccgauaccgaaaccccgcacuggaacaauaaagaagcccucguagaguucaaggacgcgcacgccaagagacagacagucguaguccuuggaagccaggaaggcgccguacacacugcccucgccggagcauuagaagccgaaauggacggcgcgaaaggccgacuaucaucuggccaccugaaaugccggcucaagauggacaagcugcgucucaagggagugucauacucacucugcacagccgcauucacauucaccaagguccccgcugaaacccuccacggaaccgugaccgucgaaguccaauacgccggacgagacggaccuugcaagguucccgcccagauggccgucgacaugcaaacccuaacacccgucggcagacuaaucaccgccaaccccgucaucacagaaucaacagaaaacucaaagaugaugcuagaacuagacccaccauucggggacagcuacauaguaauaggcgucggagacaagaaaaucacgcaccacuggcaccgcagugggucaauaauaggcaaagcguucgaagccacgguccgcggagccaaacgcauggcaguacuaggcgacaccgccugggacuucggaagcgucggaggcguguucaacucacucggcaaaggaauacaucaaauauucggcgcugccuucaaaucucuauucggagguauguccugguucucacaaauacuaaucggaacccuccucgucuggcucggacuuaacaccaaaaacgggagcaucucacugaccugccucgcccucggcggcguaaugaucuuccuaagcacagcaguauccgcagacgucggcugcagcguagacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7323 - RNA, 2506 nt, Artificial Sequence
  KX601166.1 prME-long mRNA Design 2 opt
ggggcgcugccuacggagguggcagccaucuccuucucggcaucaagcuuaccaugcgcaucauaaacgcccgcaaagaaagaaaaagaagaggagccgacaccaguaucggaauaguuggacuccuccuaacaaccgccauggccgccgaaauaacccgccgcggcagcgcuuacuacauguaccucgacaggagcgaugcaggcaaagccaucucauucgccacaacuuugggcguaaacaaaugccacgugcaaaucauggaccucggccacaugugcgacgccacuauguccuacgaaugccccaugcucgacgaaggcguagaaccugacgacguagacugcuggugcaauacaaccagcaccuggguagucuauggaacaugccaccacaagaaaggugaagcacgccgaucacggagagccguaacccuacccucucacagcacccgcaaacuacaaacccgcucccaaacauggcuagagucacgcgaguacaccaaacacuuaaucaaaguggaaaacuggaucuuccguaaccccggcuucgcccucgucgcagucgccauagccuggcuccucggcucauccacaucccaaaaagucauauaccuaguaaugauacuccuuauugcaccagccuacagcaucagaugcaucggcgucucaaaccgagauuucgucgagggcaugucuggaggaaccugggucgacguaguccucgaacacggaggcugcgucaccguaauggcccaagacaaaccaacaguugacauagagcuagugaccaccacagugagcaauauggccgaaguucgauccuacugcuacgaagccagcaucucagacauggccagugacucucgcugccccacccaaggagaggccuacuuagacaaacaaagcgacacacaauacgucugcaagcgcacccucgucgaccgcggauggggaaacgguugcggauuauucggcaaaggcucucucguuaccugcgcgaaauucaccuguuccaagaaaaugaccggcaaaagcauccaacccgaaaaccuagaauacaggauaaugcucagcguccacggcucgcaacacuccggaaugaucgucaacgaugaaaaccgggccaaagucgaagucacgccgaacucaccaagagcugaagcuacacuaggcggcuucggaagccucggccuggacugcgaaccccgcacaggccucgacuucucagaccucuacuaccucaccaugaacaacaaacacuggcucguacacaaagaaugguuccacgacauaccccucccauggcacgcaggcgcagacacaggcacaccccacuggaacaacaaagaagcacucguggaguucaaagacgcccacgcaaaacggcaaacagucgucguacuaggcagccaagaaggcgcuguccacaccgcacuugcaggcgcccucgaagccgaaauggacggagcuaaaggcagacucuucagcggccaccuaaaaugccgccucaagauggacaaacugcgacuuaaaggcgucucguacucccuaugcacagcagccuucaccuucacaaaggucccggcggaaacacuacacgggaccguaaccgucgaaguacaauacgcaggaaccgacggccccugcaaaguacccgcacaaauggcggucgacaugcaaacacugacccccgucggacgccugauaaccgccaaccccgucauaaccgagucaacagaaaacagcaaaaugaugcucgaacuagacccucccuucggcgauucuuacaucgucauaggagucggcgacaagaaaaucacacaccacuggcacagauccgguucaacaaucggcaaagcauucgaggccaccguccgcggcgccaaacgcauggcagucuuaggcgacaccgccugggacuucggcagcguaggcggaguauucaacagucucggcaaaggcauccaccaaauauuuggcgccgcguucaaaagccuguucgggggcauguccugguucucccaaauccucauaggaacccuccuaguauggcuuggacuaaacaccaaaaacggcuccauaucccuaaccugccucgcucucggcggggugaugauauuccucagcacagcaguguccgccgacgucggcugcuccguugacuucuccaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7324 - RNA, 2524 nt, Artificial Sequence
  KF383118.1 prME-long mRNA Design 2 opt
ggggcgcugccuacggagguggcagccaucuccuucucggcaucaagcuuaccaugcgaaucauaaacgcaagaaaagaaagaaaaaggagaggcgccgacaccucaaucgguauaaucggccuacuccucacaacggccauggccgcagaaaucacaagacgaggcuccgcauacuacauguaccucgaccguucagacgcgggcaaagcaauaucauucgccacaacccucggaguaaacaaaugccacguccaaauaauggaccuaggacacaugugcgacgccacuaugagcuacgaaugcccaaugcuagacgaaggagucgaacccgacgacgucgacugcuggugcaacaccaccucgaccuggguaguguacgggaccugccaccacaaaaagggggaaacccgaagaucccggaggagugugagccuaagguaccacuacacacgaaaacuccagaccagaagccaaaccuggcuggaauccagagaauacaagaaacaccucauaaugguagaaaacuggauauucagaaacccaggauucgcgauagucagcguggcaaucacauggcuaaugggaagccucaccucccaaaaaguaauauacuuagugaugaucguccucauaguaccagccuacagcaucagcugcaucggagucagcaaccgcgacuuagucgaggggaugucgggcgggacaugggucgacguaguacucgaacauggaggcugcguaacagaaauggcacaagacaaacccaccguagacaucgagcucguaaccaugacagucucaaacauggccgagguccggucguacugcuacgaggcgucccugucagauauggcaagcgccuccagaugcccuacccaaggcgaaccaagucucgacaaacaaucagacacccaaagcguaugcaaaagaacacucggagacagggguuggggaaauggcuguggaauauucggaaagggaagccuaguaacaugcaguaaguuuaccugcugcaagaagaugccaggaaaaucaauacaaccagaaaaccuggaauaccgaauaaugcuccccguacacgguucacagcacagcggcaugaucguaaacgacauuggacacgaaacagaugaaaacagggccaaaguggaagugacaccgaacagcccacgcgcagaagccacccucggaggcuucggcucacucggacuggacugcgaaccacguacggggcuugacuucagcgaccucuacuaccugacgaugaacaacaaacacuggcuaguacacaaagagugguuccaugacauaccccuacccuggcacgccggcgcagauacaggcacgccucacuggaacaacaaggaggcacucgucgaguucaaagacgcccacgcaaaaaggcaaaccguagucgugcucggcucccaggaaggagcaguacauacagcacuggccggagcccuagaagcagaaauggacggagccaaaggacgccucuucucaggccaccugaaaugcaggcucaaaauggacaaacugagacucaagggcguaagcuacagccucugcacagcagccuucacauucaccaaagugcccgcagaaacacuccacggaacggucaccgucgaaguacaauccgccggaacagacggccccugcaaaguacccgcacaaauggcugucgacaugcaaacauuaacacccgucggacgacugaucaccgcaaauccgguaaucaccgaauccacagaaaauagcaaaaugaugcucgaacucgacccacccuucggagacagcuacauagucaucggcgucggugacaaaaagaucacccaccacuggcacaggagcggcagcacaauaggaaaagccuucgaagcaaccgugcgaggagcgaaaagaauggcaguguuaggcgacaccgccugggacuucggcucaguaggaggaguguucaacagccuaggaaaaggaauacaccaaaucuucggcgcggcauucaaaagucuuuucggaggaaugagcugguucagccagauauuaauaggcacccuccucguauggcuaggucuaaacaccaaaaacggcuccaucucacuaaccugccucgcgcuaggcggagucaugaucuuccucagcacagccgucuccgcagacguagggugcucagucgacuucagcaaaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7325 - RNA, 2518 nt, Artificial Sequence
  KF383120.1 prME-long mRNA Design 2 opt
ggggcgcugccuacggagguggcagccaucuccuucucggcaucaagcuuaccaugcgcauaauaaacgcccgaaaagaacgcaaacgaagaggcgccgacacaucaauaggaauaauaggccuccucuuaacgacagcgauggcagccgaaauaaccaggagggguucagccuauuacauguaccuggaccgcagcgacgcaggaaaagccaucucguucgcaacaaccaugggagucaacaagugccacguacaaaucauggaccuaggacacaugugcgacgccacaauguccuacgaaugcccuaugcuagacgaaggcguagaacccgacgacgucgacugcuggugcaacaccaccagcacaugggugguauacggaaccugccaccacaagaaaggagaagcgagaccguccagacgagcgguaacacugccgagccacuccacccgcaaacuucaaaccaggucacaaacauggcucgaaagcagagaauauacaaagcaccuaaucaaagucgaaaacuggauccuccgcaacccaggauucacaguggcagcacuagcaauggccuggcuacugggaaacagcaccucacaaagagucaucuaccuagucaugauccuacuaaucgcccccgccuacucgaucaggugcaucggcguuagcaaccgggacuucguagaaggcaugagcggcggaacaugggucgacguagugcucgaacacggcgggugcgucacaguaauggcacaagacaaacccacagucgauaucgagcuagucaccacaacaguaagcaacauggccgaagucaggucguacugcuacgaagcaagcauaagcgacauggcaagugacagcagaugccccacccaaggggaagccuaccuagacaaacaauccgacacccaauacgucugcaagcgcacccuagucgacagaggguggggaaacggcugcggccuauucggcaaaggaucccuaguaacaugcgcaaaauuuaccugcagcaaaaagaugacaggcaaaucaauccaacccgaaaaccucgaauacagaaucaugcucucaguccacgguucacaacacucggggaugaucgucaacgauaucggacacgaaaccgaugaaaacagagcaaaggucgaagucacuccaaacuccccuagagccgaagcaacccucggaggauucggcucccucggccuagacugcgaaccacgcaccgggcucgacuucagcgaccuauacuaccuaacaaugaacaacaaacacuggcugguacacaaagaaugguuccacgacauaccacuaccuuggcacgcaggggccgacaccggcacaccccacuggaacaacaaagaagcgcuaguagaguucaaggacgcacacgcaaaaagacaaaccgucguaguacuaggaagccaggaaggcgcgguccacaccgcgcuggccggcgcacuagaagccgaaauggauggagcaaaagggcgccucuucuccggccaccucaaaugccggaucaaaauggacaaguuaagacuaaaaggcgucucauacagccuuugcacagcagccuucacauucucgaaagugccggcagagacacugcacggcaccguaaccgucgaaguacaauaugcaggcagagacggcccaugcaagguacccgcacaaauggcagucgacaugcagacacuaaccccagucggccgccuaauaacagcaaaccccaucaucacagaaagcacagaaaacucccgcaugaugcucgaacuagacccacccuucggcgacagcuacauaguaaucggggucggcgacaagaaaauaacacaccacuggcaccgaagugggagcacaaucggaaaagcauucgaagccacagucagaggagccaaacggauggcaguccucggcgacaccgcaugggacuucggaagcgucggaggcgucuucaacucauugggcaaaggaguccaccaaguuuuuggggccgcauucaaaagccuguucggagggaugagcugguucucgcaaauacuaaucggcacccugcucgucuggcucggccucaacacaaagaacggaucuaucucacuugcaugccucgcacucggcggcgccaugaucuuccuauccacggcagucagcgccgacguaggcuguagcguagacuucugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7326 - RNA, 2449 nt, Artificial Sequence
  KU321639.1 prME-short mRNA Design 2 opt
ggggcgcugccuacggagguggcagccaucuccuucucggcaucaagcuuaccaugacaucaguaggaauaguaggccugcuacucaccaccgcaauggccgcggaagucaccagaagagggagcgcauacuacauguaccuagacaggaacgacgcgggagaggccauaucauucccaacuacgcuagguaugaacaaaugcuauauccaaauaauggaccuagggcauaugugcgacgccacgaugaguuacgagugccccaugcuagacgaaggggucgaaccggacgacguagacugcuggugcaacacaaccucaaccuggguagucuacgggaccugccaccacaagaaaggcgaagcacgccgaucaagacgagcgguaacccucccaagccacucgacaagaaaacuccaaacccgaagucaaaccuggcucgaaucucgcgaauacaccaaacaccucauucgaguagaaaacuggaucuuccggaacccaggcuucgcguuagccgccgccgccauagcauggcuacuuggaagcuccaccucccaaaaagucauauaccuaguaaugauccuccucauagcgccagccuacuccauuagaugcauaggcguaagcaauagagacuucgucgaaggcaugagcgggggcacguggguugacaucguccuggagcacggcggcugcguaacaguaauggcccaagacaaaccaaccguugacaucgagcuagugacgacaaccguaucaaacauggcagaaguaagguccuacugcuacgaagcaagcaucuccgacauggcaucagacagcagaugcccgacacaaggagaagcauaccuagacaagcaaagcgacacccaguacguaugcaaaagaacgcuggucgaccgcggauggggaaacggaugcggccuauuuggcaaaggaagccuaguaaccugcgccaaauucgcaugcuccaaaaagaugacaggcaaauccauccaaccagaaaaccuagaauaucgaaucauguuaagcguacacggaagucaacacucaggcaugaucgucaacgacacaggacacgagacagacgaaaacagagcaaaagucgaaaucacaccaaauucaccccgagcagaagccacccuagggggcuucggaucgcucggccuagacugugaaccacgcaccggacuggauuucagcgaccuauacuaccuaaccaugaauaacaagcacuggcucguacacaaagaaugguuccacgacauaccacucccauggcacgccggcgccgacacagggacgccacauuggaacaacaaagaagcacucguagaauuuaaagacgcccacgccaaacgacaaacagucguggucuuggggucccaagaaggcgcgguccacacagcacucgccggcgcccuggaagcggaaauggacggcgccaagggcagacugucaucgggccaccuaaaaugccgacuaaagauggacaaacuccgccucaaaggcguaucauacucccucugcacggcagcauucacauucaccaaaauacccgcggaaacacuacacggcaccgucacaguagaaguccaauacgccggaacggacgggccguguaagguccccgcccaaauggccgucgauaugcaaacccugacuccagucggccgacuaaucacagcaaaccccgucauaacugaauccacagagaacaguaagaugaugcucgagcucgacccacccuucggcgacagcuacauaguaaucggagucggcgagaagaaaauaacacaccacuggcaccgcagcggauccaccauaggcaaagccuucgaagccaccguccgaggugccaaacgcauggcaguacugggcgacacagccugggacuucggcagcgucggaggagcccuaaacagccugggaaaaggcauacaccaaaucuucggagccgccuucaaaucccuuuucggaggcauguccugguucagccaaauccugaucggcacccugcuuauguggcuaggccuaaacaccaaaaacggauccaucagccuaaugugccuggcccuaggcggugugcuaaucuuccuaagcacugccguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7327 - RNA, 2449 nt, Artificial Sequence
  KU312312.1 prME-short mRNA Design 2 opt
ggggcgcugccuacggagguggcagccaucuccuucucggcaucaagcuuaccaugacuucagucggcaucguaggccuacuccucaccaccgccauggcagccgaaguaacccgccgcggcuccgcauacuacauguaccucgacaggaacgacgcuggcgaagccaucuccuuccccacaacccucggaaugaauaaaugcuacauccaaaucauggaccucgggcacacaugcgacgcaacuauguccuaugaaugccccaugcuagacgaaggcgucgaacccgaugacgucgauugcuggugcaacacaaccucaaccuggguagucuacggaaccugccaccauaagaaaggcgaagcccgcagaucccgacgcgccguaacacuaccgucccacuccacgcgcaaacuccagacaaggagccagacauggcuagaaagccgcgaauacaccaaacaccuaauaagaguagagaacuggaucuuccgaaacccaggauucgcacucgcagcagcagccaucgcauggcuacucggauccagcaccucccaaaaaguaauuuaccuggucaugauccugcuaauagcgcccgcauacagcaucaggugcauaggggucuccaauagagacuucguagaaggcaugagcggcggaacguggguagacgucguacucgaacacggcggcugcgucacuguaauggcccaagacaaaccuacgguugacaucgaacucguaacaacaaccgucucaaacauggccgaaguacgauccuacugcuacgaagccucaauauccgacauggccuccgacagccggugccccacgcaaggcgaagcauacuuagacaaacaaagcgacacacaauacgucugcaaacgaacacuggucgaccgcggcuggggaaacggcuguggacuauucggaaaaggcucacucguaacaugcgcaaaauucgccuguagcaagaaaaugacaggaaaaagcauccaacccgaaaaccucgaauaccgaaucaugcugucaguccacggaagccaacauucaggaaugaucgucaacgacacaggacacgaaacugacgaaaacagagccaaggucgagauaacaccaaacagcccacgugcagaagccacccuaggaggguucgggucacucggccuugacugcgaaccgcggacgggacuagacuucagcgaccuuuacuaccucacaaugaacaacaaacacuggcuaguucauaaagaaugguuccacgauaucccacugcccuggcacgcaggcgccgacacaggcacaccacacuggaacaacaaggaagcccucgucgaguucaaagacgcccacgcgaaaagacaaaccgucgucguacuaggcucacaagagggcgccguccacaccgcccuagccggcgcccuagaggcagaaauggacggcgcaaagggccgccucucauccgggcaccucaaaugccgccucaaaauggacaaacuccgucuuaaaggcgucucguauucccuaugcaccgccgccuucacguucaccaaaauaccggcagaaacgcuccacggaaccgucaccguagaaguacaguaugccggcacggacggccccugcaaagucccagcccaaauggccgucgacaugcagacacucaccccagucggcaggcuaaucacggcgaaucccgucaucacagaauccacagaaaacucaaaaaugaugcuagaacuagacccgccauucggcgacaguuacaucgucaucggagucggcgaaaagaagaucacacaucacuggcacagaagcggcagcacaauagggaaggccuuugaagcaaccgucagaggugccaaaagaauggcaguccucggcgacaccgccugggacuucggaucgguaggcggugcccucaacucccuaggaaagggcauccaccaaaucuucggugccgcauucaaaucccuauucgggggcaugucaugguucucacagauacuaauaggaacccuccucauguggcuaggccuaaacgccaaaaacggcagcauaagccugaugugccuagcccucggcggcguacuaaucuuccucagcacagccgucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7328 - RNA, 2437 nt, Artificial Sequence
  AY632535.2 prME-short mRNA Design 2 opt
ggggcgcugccuacggagguggcagccaucuccuucucggcaucaagcuuaccaugacgagcauaggcauaauaggacucuugcucacaaccgcaauggccgccgaaaucacgcgacgaggcucagccuacuacauguaccuagacagaagcgacgcaggcaaagccaucucguucgcaaccacacucggaguaaacaaaugccacguacaaauaauggaucucggacacaugugcgaugcaacaauguccuacgagugccccauguuagacgaaggaguagaaccggacgacgucgacugcuggugcaauaccacaagcacguggguaguauauggcacgugccaccacaagaaaggcgaagcacgcagaagccggcgcgccgucacgcuacccagccauagcaccagaaagcuccagacacggucccaaaccuggcucgagagccgcgaauauacaaaacaccugaucaaggucgaaaacuggaucuuccggaauccuggauucgcacucgucgccguugcaaucgcuuggcuccuaggcucgagcacgagccaaaaaguaaucuaccucguaaugauacuacuaaucgcgcccgcauauucuauccgaugcauaggcgugagcaaccgugacuucgucgaaggaaugucgggcgggacaugggucgauguaguacuagagcacgggggaugcgucacggucauggcacaagacaagcccaccgucgauaucgagcucgucacgaccacagugagcaacauggcugaagugcgcucauacugcuacgaagccuccauaucagacauggcauccgacagcagaugcccuacacaaggugaagcauaccuggacaaacaaucagacacacaauacgucugcaaaaggacccuagucgaucgcggaugggggaacgggugcggacuauucggcaaaggaagccuagugaccugcgcuaaauuuaccugcucgaagaaaaugacaggaaagagcauccaacccgaaaaccucgaauacagaaucaugcucucaguccacggcucucaacauagcgggaugauaggcuacgaaacugacgaggacagagccaaagucgaggucacgcccaacagcccgcgcgcagaagcuacacugggaggauucggcagccuaggacuagacugcgaaccacgcacaggacucgacuucagcgaccuauacuaccugacaaugaacaacaaacacuggcuaguccacaaagaaugguuccacgauauaccgcucccguggcacgccggcgccgacaccgguaccccacacuggaacaacaaagaagcacucgucgaguucaaagacgcacacgcaaaaagacaaacggucguaguauuaggcucgcaagaaggcgcaguccacacagcccuagcaggcgcgcuagaagcagaaauggacggcgcgaaaggcagacuauucucaggccaucucaagugccgccuaaaaauggacaaacuccgccuaaaagggguauccuacucacucugcacagcagcauucacauucaccaaaguccccgcggaaacccuacauggcacaguaaccguagaagugcaauaugccggaacggauggccccugcaagaucccgguacaaauggcgguugacaugcagacucugaccccaguagggcgccuaaucacagcaaacccuguaaucacugaauccacagaaaacucaaaaaugaugcucgaacuggacccaccauucggggacagcuacauaguaauaggagucggcgacaagaaaaucacccaccacuggcacagaagcgggaguacaaucggaaaagcguucgaggccacagucaggggcgcaaaaagaauggcaguacuaggagacaccgcuugggacuucggcagcgugggcgggguauucaacucacucggaaaaggcauccaccaaaucuucggugcagccuucaaaagccuguucggaggaauguccugguucucccaaauucucaucggaacgcuccuagucuggcucggacuaaauaccaaaaacggaucuaucagcuuaaccugccucgcgcuaggaggagugaugaucuuccuguccacagcaguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7329 - RNA, 2449 nt, Artificial Sequence
  KU527068.1 prME-short mRNA Design 2 opt
ggggcgcugccuacggagguggcagccaucuccuucucggcaucaagcuuaccaugaccuccguaggcaucguaggccuacuccugacgaccgccauggccgccgaagucacccgccgcggcuccgcauacuacauguaccucgaccgaaacgacgccggagaagccaucagcuuucccacuacccucggcaugaacaaaugcuacauccaaaucauggaccucggucacaugugcgacgcuacuaugagcuacgaaugucccaugcuagacgagggaguugaacccgacgacgucgacugcuggugcaacacaacaucaacaugggucguauacggcaccugucaccacaagaaaggcgaagcaagacguucuagacgagccguaacacuaccaucccauucgacccgcaaauuacaaacccgcucccaaaccuggcuagaaucacgagaauacaccaaacaccucauccgcgucgagaacuggaucuucaggaacccgggauucgcacuugcugccgcagcaauagcauggcuccucggauccuccaccucccaaaaaguuauauaccucgucaugauccuccuuaucgcccccgcauacucgauccgcugcauaggugucucaaaccgagacuucguggaaggcauguccgggggcacguggguagacguggucuuagaacacggcggcugcguaaccguaauggcacaagacaaaccaacaguggacaucgaacuggucaccacaacaguauccaacauggccgaaguccgcagcuauugcuacgaagcaagcauaucugauauggcguccgacucacgcugccccacucagggcgaagccuaccuugacaagcaauccgacacccaauacgucugcaaacgcacacucgucgaccgaggcuggggcaacggaugcggacuauucggaaagggcucccuagucacaugcgccaaauucgccugcuccaagaaaaugaccggcaaaucgauacaacccgaaaaccucgaauaccguauaaugcuauccguccacggcucacaacauucagggaugaucgucaacgacacaggccacgaaaccgacgaaaaccgagccaaggucgaaauaaccccgaacagccccagagccgaagccacccuaggaggcuucggcucccuaggccuagacugcgaaccccgcaccggccucgacuucuccgacuuguacuaccucacgaugaacaacaaacacuggcuaguccacaaagaaugguuccacgacauaccccucccauggcacgccggcgcagauaccggaacuccccacuggaacaacaaagaagcccuagucgaguucaaagacgcccacgccaaacgccaaacagucguaguccuaggaucccaagaaggcgccguucacacggcacucgccggagcacuagaagccgaaauggacggcgcaaaaggccgucuauccucaggccaccuuaaaugccgccugaagauggauaaacuccggcucaaaggagucuccuacucacugugcaccgccgcauucacauucaccaaaaucccagccgaaacccuccacggcacaguaaccguugaaguccaauacgccggcaccgauggcccaugcaaaguaccggcccaaauggcaguagacaugcaaacacucacacccguaggacgccucauaacggccaacccaguaauaaccgaauccacagaaaacuccaaaaugaugcuagaacuagacccacccuucggggacuccuacaucgucaucggcguaggcgaaaagaaaaucacacaucacuggcaccgcucaggaucaacaauaggaaaagccuucgaagccacaguaagaggugcaaaacgcauggcaguacuaggagacacagcaugggacuuugggucagucggcggagcccugaacucacucggaaaagggauccaccaaaucuucggcgccgcauucaaaucccuauucggaggaaugagcugguucagccaaauccucaucgggacccuacuaauguggcucggccucaacaccaaaaacggcuccaucucccuuaugugucucgcucuaggcggcguacucauauuccucagcaccgccgucucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7330 - RNA, 2449 nt, Artificial Sequence
  KX421193.1 prME-short mRNA Design 2 opt
ggggcgcugccuacggagguggcagccaucuccuucucggcaucaagcuuaccaugacgagcaucggcaucauaggucuccuccuaaccacggccauggccgccgaaaucacccgccgcggcuccgcauacuacauguaccuugaccgcucagaugccggaaaagcaaucucauucgcgacaacccucggaguaaacaaaugccacguacaaaucauggaccugggccauaugugcgacgccacgauguccuacgaaugccccaugcuagacgaaggggucgaacccgaugacguagauugcuggugcaacacaacaagcaccugggucgucuacggcacaugccaccacaagaaaggagaagcacgccgaucacgccgagccgucaccuuacccucucacucaacccgaaaacuacagacaagaucccagaccuggcuugaaagccgcgaauacacaaaacaccucaucaaagucgaaaacuggauauuccggaaccccggauucgcccuaguagcaguagcaauagcauggcugcucggauccucaacaucacaaaaaguaaucuaccucgucaugauccugcuuaucgcacccgccuacucaaucagaugcauaggagucagcaaccgcgacuucgucgaagggaugucaggaggcacgugggucgacguaguccuagaacacggcggcugcgucacaguaauggcccaagacaaaccuaccguagacaucgagcucguaaccaccacuguauccaauauggccgaaguccguucauauugcuacgaagccucaaucuccgacauggcaagcgacucccgaugccccacccaaggagaagcguaccucgacaaacaauccgacacccaguacgucugcaaacgaacuuugguagaccggggcuggggcaacggaugcggucucuucgguaaaggauccuuaguaaccugcgcaaaauuuaccugcagcaagaaaaugacaggaaaaucaauacaaccagaaaaccucgaauaccgcaucaugcucucaguccacgggucccaacacuccggaaugauagucaaugacacaggcuacgaaaccgacgaaaaccgcgccaaaguagaagucacacccaacagcccccgcgcagaggccacccucggcggcuucggcucccuaggccuagacugugaaccgcgaacaggccuggacuucuccgaccucuacuaccuuacuaugaacaacaaacacuggcucguccacaaagaaugguuccacgacaucccucuaccauggcacgccggagcagacaccggcacaccccauuggaacaacaaagaagcccuuguugaguucaaggacgcccacgcgaaacgacaaaccgugguaguacuugguucacaagaaggcgcaguccacacagcccuagccggagcccucgaagcagagauggacggagccaaaggcaaacucuucuccggccaccuaaagugcagacuaaaaauggacaaacuaagacuaaaagggguaucauacagccuaugcaccgccgcuuucaccuucacgaaagucccagccgaaacccuacacggcaccguaaccgucgaaguacaauacgcaggaaccgacggccccugcaaaauccccguccagauggccguagauaugcaaacacuaacccccgucggacgccuaauaaccgccaacccagucaucaccgaaagcacugaaaacuccaaaaugaugcuagaacucgacccgccauucggcgacagcuacaucguaaucggagucggggauaaaaagaucacccaccacuggcaccgcucaggcagcacgauaggcaaagccuucgaagccacaguccgcggggccaaacguauggcaguccuaggagacacggccugggacuucggcuccgucggcggagucuucaacucccuaggcaaaggcauccaccaaauauucggcgcggcauucaaaagccuauucggcggcauguccugguucucacaaauccuaauaggcacccuccuaguauggcuaggacuaaacaccaaaaacggauccauaagccuaaccugccuagcacuaggcggcguaaugauuuuccuaagcacggccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7331 - RNA, 2449 nt, Artificial Sequence
  KX377335.1 prME-short mRNA Design 2 opt
ggggcgcugccuacggagguggcagccaucuccuucucggcaucaagcuuaccaugacgaguaucgguaucauaggccuacugcugacaaccgcgauggcugcagagaucacacguagaggaagcgcauacuacauguaccuggaccgcagcgacgccggaaaagcaauaucauucgccacaacgcucggaguaaacaaaugccacguccagauaauggaccucggucacaugugcgacgcaaccaugucguacgaaugccccaugcuagacgagggagucgaaccagacgacgucgauugcuggugcaacacaaccagcacgugggucguguacggaaccugccacagaaagaaaggggaagcgagaagaagcagacgagcggucacacucccuagccacagcacacgcaaacuccaaacccgaagccaaacguggcucgaaagccgagaauacacaaaacaccucaucaaagucgaaaacuggaucuuccgcaaccccggguucgcacucguggcagucgccauagcauggcuccugggcagcagcacgagccaaaaaguaaucuaccuagugaugauacuccugaucgccccagccuacucgauacgaugcauaggcgucagcaaccgcgauuucguggaaggaauguccggcgggacguggguagacguaguccuggaacacggaggcugcgucaccguaauggcccaggacaaacccacagucgauauagagcuggugacgacaacaguaagcaacauggcagaaguacgcucguacugcuaugaagcaucgaucucggacauggcaagcgacagccgcuguccaacccaaggagaggccuaccuagacaaacagagcgacacacaguaugucugcaaaagaacccucguagacagaggcuggggaaacggaugcggccucuucggcaagggaucgcuaguaacaugcgccaaauucacaugcuccaagaaaaugacaggcaaaagcauccagcccgaaaaccuagaguaccgaauaaugcugucaguccacggcucacaacacuccggcaugauaguaaacgacaccggcuacgaaacggaugaaaacagagccaaagucgagguaaccccgaacuccccacgagcagaagcaacucucggaggguucgggagccucggguuagacugcgaaccccgcaccggauuggacuucagcgaccucuauuaccugacaaugaacaacaaacacuggcucguccacaaagagugguuucacgacaucccccuccccuggcacgcaggcgccgacacaggaacgccacacuggaacaacaaagaggccuuggucgaguucaaagacgcacacgccaaaagacaaaccguggucguacucggcagccaagaaggagcaguacacacagcgcuagcaggcgcacuagaagccgaaauggacggagcaaaagggaaauuguucucuggccaccucaaaugcagacugaaaauggacaaacuaagacugaaaggagugucauacucacugugcacagcagcauucaccuucacaaaaguaccagcggaaacccuucacgggacaguaaccguagaaguccaauacgcaggaaccgacgggccgugcaagaucccagugcagauggccgucgacaugcagacccuaaccccagucgggcgacucaucaccgccaacccaguaauaacagaaaguaccgaaaacagcaaaaugaugcuugaacuagacccacccuucggagacagcuacauaguaauaggcgugggagauaagaaaauaacccaccacuggcacagaagcgggagcacaauaggaaaagcauucgaggccaccgucaggggagcaaaaagaauggcaguacucggagacaccgccugggacuucgggucugucggaggaguauucaacucacuagggaaaggaauccaccaaauauucggcgccgccuucaagagcuuauucgggggcauguccugguucagccaaauccuaauuggaacccuccuaguguggcuaggccuaaacaccaaaaacggaagcauaagucuaacaugucuagcccuaggcggcgugaugauauuccuaagcaccgcgguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7332 - RNA, 2449 nt, Artificial Sequence
  LC002520.1 prME-short mRNA Design 2 opt
ggggcgcugccuacggagguggcagccaucuccuucucggcaucaagcuuaccaugacaagcaucggcauaaucggacuauuacucacaaccgcaauggcagccgaaauaacccgccgaggaucugccuacuacauguaccucgacaggagcgacgccggaaaagcaauaucauucgcaacaacccuagggguaaacaagugccacguacaaauaauggaccucggccacaugugcgacgccacaaugagcuacgaaugccccaugcuggacgagggcguggaaccggacgacgucgacugcuggugcaacaccacuuccaccugggucguauacggaaccugccaccacaagaaaggggaagcacgaagauccagacgagccgucacauuaccaagccacucaaccagaaaacuacagacaagaagccaaacauggcucgaaagcagggaguacacaaaacaccugauaaaagucgaaaacuggauauuccgcaaccccggguucgcccucguggccguagcaauagccuggcuacuaggcuccagcacaagccaaaaagucaucuaccuagucaugauccuccuaaucgcgccagcauacuccauccgguguauaggcgucucaaacagagacuucgucgaagggaugucaggcggaaccuggguagacgugguacucgagcacggaggcugcguaacagucauggcccaagacaaacccaccgucgacaucgaacugguaacaaccaccguaagcaacauggcugaaguccgauccuacugcuaugaagccagcaucucagacauggcaagugacucacgaugcccaacccaaggcgaagccuaccuggacaagcaaagcgacacccaguacgucugcaaacgcacccuagucgaccgaggguggggaaacggcugcggccucuucggaaaaggaucgcuagucacgugugcaaaguuuaccugcuccaagaaaaugacaggcaaaaguauacagccugaaaaccucgaguaucgaaucaugcuaucugugcacggcucacaacacucaggaaugacggucaacgacauaggauacgagaccgacgaaaaccgcgcaaaagucgaggucaccccaaacagcccacgggcagaagccacccucggaggguucggcagccuaggccucgauugcgaaccaagaacaggccuugacuucuccgaccuauacuaucucaccaugaacaacaaacacuggcugguccacaaagaaugguuccacgacauaccacuccccuggcacgcaggcgcggacacagggacgccacacuggaacaacaaagaagcccuaguagaguucaaagacgcacacgccaaacgacaaaccgucgucguucuaggcucccaagaaggcgcaguccacacggcccuagcaggagcgcuagaagccgagauggacggcgccaagggcaaacucuucagcggacaccuaaaaugcaggcuaaaaauggacaaacuacggcucaagggaguaucauacucgcugugcaccgcggcguucaccuucaccaaaguacccgccgagacccuccacggaaccguaaccgucgaaguccaauacgcagggacugacggcccgugcaaaaucccaguccaaauggcagucgacaugcaaacacuaacaccagucgggcgacucaucacagcaaaccccguaaucacagaauccaccgaaaacuccaagaugaugcucgagcuagacccgccauucggagacagcuacaucguaauaggagucggagacaaaaagaucacccaccacuggcaccgcucgggaagcacaaucggcaaggccuucgaagcaacuguaagaggcgcaaaacgcauggccguacuaggagacaccgcuugggacuucggcagcgucggcgggguguucaacucccuaggaaaaggcauacaccaaauauucggagcagcuuuuaaaucccuguucggcggcaugagcugguucagccaaauacuaauaggcacccucuuagucuggcuaggacucaacacaaagaacggcucaaucucacuaaccugccucgcacuaggaggagucaugauauuccugagcacagccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7333 - RNA, 2431 nt, Artificial Sequence
  DQ859059.1 prME-short mRNA Design 2 opt
ggggcgcugccuacggagguggcagccaucuccuucucggcaucaagcuuaccaugacaagcauaggcauagucggccugcuacucaccacugccauggccgccgaaauaacacgcagaggcuccgccuacuacauguaccucgaccgcuccgacgcaggaaaagccaucuccuucgcaaccacgcucggcgucaacaaaugucacguacaaauaauggaccuaggccacaugugcgacgccaccaugagcuacgaaugccccaugcucgacgagggcgucgagccggacgacguagacugcuggugcaacacaaccucuacauggguagucuauggaaccugccaucacaagaaaggcgaggcccgacgaagccgacgagcaguuaccuuacccagccacagcacacgcaaacuccaaacaagaagccaaacauggcuagagagccgagaauacacaaaacaccucaucaaagucgaaaacuggauauuccggaauccaggcuucacacucgucgcaguagcaauagccuggcuccucggcagcagcaccagccaaaaaguaaucuaccuagucaugauccuccuaauagcgccagccuacuccauaaggugcauaggaguaagcaaucgcgacuucguagaaggaaugagcggaggcaccugggucgacguaguccucgaacacgggggaugcguaacaguaauggcccaagacaagccaacaguagacauagagcucgucacaacgaccgucaguaacauggcagaagucaggucuuacugcuacgaagcaagcaucagcgacauggcaucagacagccgaugccccacccaaggagaagcguaccuagacaagcaaucagacacccaauacgucugcaaaaggacccuuguagauagaggauggggaaacggaugcggccucuucggcaagggcagccuaguaaccugcgcaaaauucacaugcucaaagaaaaugaccggcaaaucaauccaaccagaaaaccuugaauaccgaaucaugcucuccguccacggaagccaacacagcggaaugauagucaacgacgaaaacagagcaaaagucgaagucacucccaacucaccccgagccgaagccacccugggcggcuucggaucccugggacuugacugcgaaccucgcaccggccuagacuucagcgaccuauacuaccucacaaugaacaacaaacacuggcuaguccacaaagaaugguuucacgacauaccccucccauggcacgccggcgcagacaccggaacaccccauuggaacaacaaagaagcccuagucgaguucaaagacgcacacgcaaaacggcagacaguagucguacuaggcucccaggagggcgcaguacacaccgcacuggccggcgcccuggaagccgaaauggauggcgcaaaaggaaggcuguucucgggacaccucaaaugcaggcugaaaauggacaaacuaagacucaaagggguaucauacuccuuaugcacagccgccuucaccuucaccaaaguaccagcagagacgcuccacggcaccgugaccgucgagguacaauacgccggcaccgacggaccaugcaaaguccccgcccaaauggcaguagauaugcagacacugaccccagucggcagacuaauaaccgccaacccgguuauaaccgaaagcaccgaaaacucaaaaaugauguuggaacuggacccacccuucggcgauagcuacauagucauagguguaggagacaagaaaaucacccaccacuggcacagaucagguagcacaaucggcaaagcguucgaagccaccguccgcggcgcaaaaaggauggccguacucggcgacaccgccugggacuucggcagcgugggaggagucuucaacagccuaggaaaaggcauccaccaaaucuucggagccgccuucaaaagccucuucggaggaaugagcugguucucccaaauccucaucggaacccuacuggucuggcucggccucaacaccaaaaacggcagcaucucucuaaccugccucgcacuaggcggcgucaugauauuccucagcaccgcggucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7334 - RNA, 2437 nt, Artificial Sequence
  KU963573.2 prME-short mRNA Design 2 opt
ggggcgcugccuacggagguggcagccaucuccuucucggcaucaagcuuaccaugaccucaaucggaaucaucggacuauugcucaccaccgcgauggcagcagaaaucacacgcagaggauccgcauauuacauguaccuugaccgcagugacgccggcaaagcaaucucuuucgccacaacacucggagucaacaaaugccacguccaaaucauggaccucggccacaugugcgacgccacaauguccuacgaaugccccaugcucgacgaaggcgucgaacccgacgacgucgacugcuggugcaacaccacauccacuugggucgucuacggaaccugccaccacaagaaaggcgaggcgagacgcuccagacgcgccgucacacuacccucgcacuccacaaggaaacuccagacccgaagccagaccuggcuagagucccgggaauacaccaaacacuuaaucaaaguagagaacuggauauuuagaaaccccggauucgcucucgucgccgucgcaauugcuuggcuccuaggcucaagcaccagucaaaaaguuauuuaccuagucaugauacuacuaaucgcacccgccuacuccauccgcugcaucggagucaguaaccgcgacuucguggaaggcauguccggaggaacgugggucgacguaguccucgagcacggaggaugcgucacagucauggcacaggacaaaccaaccgucgacauagagcuagucaccacgacagucucaaacauggccgaaguaaggucuuacugcuacgaagccagcaucuccgauauggccucagacucccgaugccccacccaaggagaggccuaccucgacaaacaaucagacacccaauacguaugcaaaagaacccuaguugaccgcggcuggggaaacggcugcggccucuucggcaaagggagccuaguaaccugcgcaaaauucacaugcuccaagaaaaugaccggcaaauccauccaaccagaaaaccucgaguaccgcauaaugcucucaguacacggcucacaacacagcggaaugauaggcuacgaaaccgacgaaaaccgcgccaaagucgaagucacccccaacagcccacgcgccgaagccacacucggcggauucggcucccuaggccuagacugcgaaccccgcaccggucuugauuuuucagaccuuuauuaccucacaaugaacaacaaacacuggcucgugcauaaagaaugguuucacgauauaccacuaccguggcaugcgggagcagacaccggcacgccccacuggaacaacaaagaagcacucgucgaguucaaagacgcccaugccaaacgccaaaccguaguaguucuaggaucacaagaaggagcaguccacaccgcccucgccggagccuuagaagcagaaauggacggagcgaaaggcaaacuguucagcggccaccuaaagugcagacucaaaauggacaagcuccgccucaaaggcgucucauacucacuaugcaccgcagccuucaccuucaccaaggucccagcagaaacccuccacgggaccgucacugucgaaguccaguaugcaggcacggacggaccaugcaagaucccgguccagauggcaguagacaugcaaacccucacacccgucggccgacucaucacagcaaaccccgugaucacagaauccacugaaaacucaaaaaugaugcucgaacucgacccgcccuucggcgacagcuacaucgucaucggcgucggcgacaaaaagauaacccaccacuggcaccgcagcgggucaacuaucggcaaagcauucgaagccaccguccgcggcgccaaacgaauggccguacucggagacacggccugggauuucggcuccguaggcggaguauucaacagccuaggaaagggcauccaccaaaucuucggagcagcauucaaaagccuauucggcggcaugucaugguuuucccaaauacugaucggcacacucuuagucuggcucggacucaacaccaagaacggcuccaucagccuaaccugccucgcacuaggcggagucaugaucuuccuaagcaccgccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7335 - RNA, 2449 nt, Artificial Sequence
  KX694534.2 prME-short mRNA Design 2 opt
ggggcgcugccuacggagguggcagccaucuccuucucggcaucaagcuuaccaugaccuccgucggaauagucggccucuuacuaaccacugccauggccgcagaaguaacccgccgagggagcgcauacuacauguaccucgaccgcaacgacgcaggagaagccaucagcuuccccacgacgcuaggcaugaacaagugcuacauacagaucauggaccuaggccauaugugcgacgccacaaugucauacgaaugcccaaugcuagacgaaggcgucgaacccgacgacgucgacugcuggugcaauacaacaagcacuuggguagucuacggaaccugccaccacaagaaaggggaagcacgacgaagccgccgagcagucacucuccccucacacagcacccggaaacuccaaacacgcagccaaaccuggcuagaaagccgagaauauacaaaacaccucauacgaguagaaaacuggaucuuccgaaacccaggcuucgcauuagccgccgcggccaucgccuggcuacugggcucgucaacaucacagaaaguuaucuaccuaguaaugauacuucuaaucgcccccgccuacagcauaagaugcaucggcguaagcaacagagacuucguagaggggaugagcggcgggaccuggguagacgucguccuggagcacggcgguugcgucacgguaauggcccaagacaaaccaaccguugacaucgaacucguaacgacgaccguguccaacauggcagaaguccgaucauacugcuacgaagccagcaucagcgacauggcauccgacucuagaugcccgacccagggagaagccuaccuugacaaacaaagugacacacaauacgucugcaaacgaacccucgucgaccgcggcuggggcaacggcugcggccucuucgggaaaggcagccuaguaaccugugcgaaauucgcaugcagcaagaaaaugacagggaaauccauacagccagaaaaccuagaauaccgcauaaugcugaguguccacggaucucaacacagcggcaugaucguaaacgacacaggacacgaaacagacgaaaaccgagcaaaaguagagaucaccccgaacagcccccgagcggaagcaacacuaggcggauucggcagccugggccucgacugugaacccagaacaggcuuagacuucagcgaccucuacuaccucaccaugaacaacaaacacuggcucguccauaaagaaugguuccacgacaucccgcucccauggcacgccggcgcagacacaggaacgccacacuggaacaacaaagaggcgcuaguggaguucaaagacgcacacgccaaacgccagaccguagucguacuaggaucacaagaaggcgccguucacacagcccuagccggagcacucgaagccgaaauggacggcgcaaagggcagacuaucaucaggccaccuaaaaugccgccuaaagauggacaaacugcgccuaaaaggcgugucauacucacuaugcacagcagcauucacguuuaccaagauaccagcagaaacacuacacgguacagucaccgucgaaguccaauacgcagggaccgacggaccaugcaaaguacccgcccaaauggcaguggacaugcaaacacucacaccgguaggacgacuuaucaccgccaacccgguaauaacagaauccaccgaaaacagcaaaaugaugcucgaacucgacccacccuucggagacuccuacauaguaauaggcgucggagaaaagaaaaucacacaccacuggcaccgcuccggcuccaccaucgggaaagcauucgaagccacagucagaggagccaaacgaauggcgguccugggcgacacggcaugggacuucggaagcgucgggggcgcacucaacucacucggccguggaauacaccaaaucuucggggccgcguucaaaagccucuucggcggcaugagcugguucucgcaaauccucauaggcacccuacucauguggcucggacuaaacaccaaaaacggaucaaucagccucaugugcuuagcccuaggcggcguccucauuuuucucagcaccgcgguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7336 - RNA, 2449 nt, Artificial Sequence
  KX369547.1 prME-short mRNA Design 2 opt
ggggcgcugccuacggagguggcagccaucuccuucucggcaucaagcuuaccaugaccuccguaggaaucguuggcuuacuccucaccaccgcaauggcagcagaaguaacucggcgcggcucagccuacuacauguaccucgaccgcaacgacgcaggagaagccauaagcuuccccaccacccuuggcaugaacaaaugcuacauccaaauaauggaccuuggucacaugugcgacgcgaccaugagcuacgaaugccccaugcuagacgaaggagucgaaccagacgacguagacugcuggugcaacaccacaagcaccugggucguauacggcaccugccaccacaaaaaaggcgaagccagacgcucacgacgagccgucacucuucccucccacuccacccgcaaacuacaaacgcgaucccaaaccugguuagaaagccgcgaauacaccaaacaccuuauaagggucgagaacuggauauuccgcaaucccggacuagcucuugcagccgcagcaauagccuggcuacuaggaucguccaccucacaaaaagucauauaccuagucaugauccuccuaauagcuccagccuacagcauacguugcaucggcguuuccaaccgggacuucguagaaggcaugagcggcggcaccugggucgacguuguacuggaacacggaggaugcgucaccgucauggcccaagacaaacccacugucgacaucgaacuaguaaccacaaccgucagcaacauggccgagguacgcagcuacugcuacgaggcguccaucagcgacauggcguccgacucacggugccccacccaaggcgaagcauaccuagacaaacaaucugacacccaauacguaugcaaacgaacccucguggaccgaggauggggcaacggcugcggccuguucggcaaaggcucacuagucaccugugcaaaauucgccugcuccaaaaaaaugacagggaaauccauacaacccgaaaaccuagaauauagaaucaugcuaagcgugcacgguucccagcauuccggcaugauaguaaacgacaccggccacgaaaccgacgaaaaccgugcaaaagucgaaauaacuccaaacucaccccgcgccgaagcaaccuuaggcggcuucggcucacucggccuagacugcgagccccgcaccggguuagacuucuccgaccuguacuaccuuaccaugaacaacaaacacuggcuaguacacaaagaaugguuccacgacauaccccuaccauggcacgcgggggccgacacaggaaccccccacuggaacaauaaagaagcccucgucgaauucaaagacgcccacgcuaagcgccaaaccguagucguccuagggucacaggagggagccguccacacugcccuagccggcgcucucgaagcagaaauggauggcgcaaaagggcgacuuagcuccggacaccuaaaaugucgccucaaaauggacaaauugcgacuuaaaggagucucuuacucucucugcaccgccgccuucacauucacaaaaaucccagccgaaacccuccacggcaccgucaccguagaaguccaauaugcaggcaccgacggacccugcaaagucccugcacaaauggccgucgacaugcaaacacucacaccaguaggccgacucauaacugccaacccgguaaucaccgaauccacugaaaacucgaaaaugaugcucgaacucgacccaccauucggagacucauacauagucauaggugucggagaaaaaaaaauaacccaucacuggcacagaucaggcucaaccaucggcaaggcauucgaagccaccguaaggggcgcaaaacgcauggccguccuaggagacaccgcaugggacuucggaucgguaggcggcgcacucaacagccuaggcaaaggcauacaccagauauucggcgcagccuuuaaaagccucuucggcggaaugucaugguucagccagauccucauaggcacacuccuuauguggcuaggccuaaacacaaaaaacggauccaucucccucaugugccucgcccucggaggaguacugaucuuccuaucgaccgcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7337 - RNA, 2449 nt, Artificial Sequence
  KX447515.1 prME-short mRNA Design 2 opt
ggggcgcugccuacggagguggcagccaucuccuucucggcaucaagcuuaccaugacaagcguagguauagucggccuccuccucaccaccgcaauggcagccgaggucacacgcagaggcagcgcauacuacauguaccuagaccggaacgacgcaggagaagcaaucucguucccaaccacccuugggaugaacaaaugcuacauacagauaauggaccugggacauaugugcgacgccacaauguccuacgaaugcccaaugcucgacgaggggguagaacccgaugacguagacugcuggugcaacaccacaagcacaugggucgucuacggcacaugccaccacaagaaaggggaagcccggaggagcagacgagcagucacacuccccagccacagcacaagaaaacuacagacccgcucacaaaccuggcuagaaagccgagaguacacaaaacaccucauacgaguugaaaacuggaucuuccgcaaccccggauucgcgcuagccgcggcagcaauagcauggcuccugggaucuagcaccagucaaaaaguuaucuaccuugucaugauacuccuaauagcccccgcauacagcauacgaugcauaggcguaagcaaccgcgacuucgucgaagggaugucaggagggaccugggucgacguaguacuagaacacggcggaugcgugacagucauggcccaagacaaacccacaguagacauagagcucgucacaaccacaguauccaacauggccgaaguccgcucguacugcuacgaagcaucaaucagcgacauggccucagacucccgcugccccacgcagggagaagcauaccucgacaaacaaucagacacacaguacgucugcaaaaggacccuaguagaccgaggaugggggaacgggugcggacucuuuggaaagggaucgcucguaacaugcgcaaaauucgccugcagcaaaaagaugacaggcaaaucaauacagccggaaaaccucgaauaccggaucaugcucuccguacacggcucacaacacucgggcaugauagucaacgacacaggccacgaaacagacgaaaacagggccaaagucgaaaucaccccgaacucaccgcgcgcagaggcuacccuaggaggguucggaucccucggccuagacugcgaaccgcgaacaggacuggacuucagugaccucuacuaccuaaccaugaacaacaaacacuggcuaguccacaaagaaugguuccacgacauaccccuccccuggcacgcaggagccgauaccggcacgccgcacuggaacaacaaagaggcccuagucgaguucaaagacgcacacgcaaaaaggcaaacggucgucguacucggcucgcaagaaggagcaguacauacagcacuagcaggcgcacucgaggccgaaauggacggagccaaagggcgccuuuccagcggccaccucaaaugccggcuuaaaauggacaaacuuaggcuaaaaggggucuccuacagccucugcaccgccgccuucacauucacuaaaaucccagcagagacccuacacggaacagugaccguagaagugcaauacgccgggacagacggacccugcaaaguacccgcacaaauggccguugacaugcagacacuaacccccgucggacgacuaaucaccgccaauccggugauaaccgaaucgacugaaaacagcaaaaugaugcucgaacucgacccacccuucggcgacagcuacaucguaauaggagucggcgaaaagaaaauaacccaccacugguaccgcuccggaagcaccaucggcaaagcguucgaagccacggucagaggugcaaaacgcauggccguccuaggcgauacggccugggacuucggaagcguugggggagcacuaaacucacuaggcaaagggauacaccaaauauucggugccgcauucaaaucccuguucggaggaaugucaugguucucacaaauacuaauaggcacacuacuaauguggcugggccucaacaccaagaacggaagcauuucccuaaugugccucgcccucggcggcguacuaaucuuccuauccacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7338 - RNA, 2449 nt, Artificial Sequence
  KU729218.1 prME-short mRNA Design 2 opt
ggggcgcugccuacggagguggcagccaucuccuucucggcaucaagcuuaccaugacgucuguaggcauaguuggccuacuccucacaacagccauggcagccgaaguaacccgccgcggcucagccuauuacauguaccuggaccgaaacgacgcuggagaagccaucucauuccccaccacccucggaaugaacaaaugcuacauacaaaucauggaccucggacacaugugcgacgcgaccaugaguuacgaaugcccaauguuggacgaaggagucgagcccgacgacguugacugcugguguaacaccaccaguacuugggucgucuacggaaccugccaccacaagaaaggggaagcccgacgaucccgccgggcgguaacccuaccuucccacagcacccgcaaacuccaaacacgaucacaaaccuggcucgaaagcagagaauacacgaaacaucucauacgaguagagaacuggauauucagaaauccgggauucgcacuagccgccgccgccaucgccuggcuccugggaucaucaaccagccaaaaaguaauauaccucgugaugauccuccuaauagcccccgcguacucaauacgcugcauaggcgucagcaaccgggacuucguagaaggcauguccgggggcaccugggucgacguaguacucgagcacggcggcugcgugaccguaauggcccaagacaaacccaccguagacaucgaacugguuacaaccacagugucaaacauggcagaagucagaagcuacugcuacgaagccucgauaagcgacauggccuccgacagccgaugccccacccaaggagaagccuaccuagacaaacaaucagacacacaauacgucugcaaacgaacccuaguagaccgcggcuggggcaacggaugcggccuuuucggaaaaggcucacuuguaaccugcgccaaauucgcaugcagcaagaaaaugaccggaaaaucaauccaaccagaaaaccuagaguaucgcaucaugcucuccguacacggaucacaacacucaggcaugauagucaaugauacgggccacgaaaccgacgaaaauagagcaaaagucgagaucacccccaacagcccccgcgccgaagcaacacucggaggauucgggagccucggacucgacugcgaaccccgaacaggccuagacuucucagaccuauacuaccucaccaugaacaacaaacacuggcucguacacaaagaaugguuucacgacauaccacuacccuggcacgcuggggccgacaccgggacuccccacuggaauaacaaagaagcccuaguagaguucaaagacgcccacgccaaacgccaaacggucguaguacucggcagccaagaaggggccguccacaccgcgcucgccggagcccucgaagccgaaauggacggagcaaagggacggcuauccucagggcaccucaaaugcagacuaaagauggacaaacuccgucugaagggcguuuccuauagccucugcaccgcagcauucaccuucacaaagaucccggccgaaacacuccacgggaccgucaccguagaagugcaauacgccggcacagauggccccugcaaaguccccgcccagauggccgucgacacccaaacgcugacacccgucggccgccuaaucaccgcgaaucccgucauaacugaauccaccgaaaacucgaaaaugauguuagaacucgaucccccauucggggacucauacaucguaauaggcgucggagaaaagaaaauaacccaccacuggcaccgaucaggcagcaccauaggcaaagccuucgaagccacuguaaggggcgcaaaacgcauggcaguacuaggagacaccgcaugggacuuuggcucagucggcggagcccucaacucccuaggcaaaggaauacaccagauuuucggagcagcuuucaaaagccucuucggcggcaugagcugguucucccagauucuaauaggcacccugcucauguggcucggacugaacaccaaaaacggauccaucucccucaugugccuagcacugggcggcguccuaauauuccugucuaccgccguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7339 - RNA, 2449 nt, Artificial Sequence
  KU501217.1 prME-short mRNA Design 2 opt
ggggcgcugccuacggagguggcagccaucuccuucucggcaucaagcuuaccaugacauccgugggcauagucggucuccuacuuaccacagcaauggcagccgaaguaacacgccgaggcucagcauacuacauguaccucgaccggaacgacgcaggcgaagcaauauccuucccaaccacacucggcaugaacaaaugcuacauccaaaucauggaccucggccacaugugcgacgccacaauguccuacgaaugccccaugcucgacgaagggguggaaccagacgacgucgacuguuggugcaacaccaccuccaccugggucgucuacgggaccugccaccacaagaaaggcgaagcccgccgaagcagacgcgcagucacacucccuucccacucaacccgcaaacugcaaacccgcucacaaaccuggcucgaaagccgcgaauacaccaaacaccuuauaagaguagaaaacuggaucuuccgaaacccaggcuucgcacucgccgcagccgccauagccuggcuacuugggagcuccacgucccaaaaaguaauauaccucguaaugauucuccuaauagcgccagccuacuccauccggugcauaggagucucaaacagagacuucgucgaagguaugucgggaggaaccugggucgacguaguacuagaacacgggggcugcgucacugucauggcacaagacaaaccgaccgucgacauagaacucguaacaaccaccgugucuaacauggccgaaauccgaagcuacugcuacgaagcaagcauaagcgacauggccuccgacucgcgaugcccaacccaaggagaagccuaccuugacaaacaaagugauacacaauacgucugcaagagaacauuaguagaccgaggaugggggaacggaugcggccuauucggcaaaggcucacucgucacgugcgccaaguucgcuugcuccaagaaaaugaccggcaaaagcauacaaccugaaaaccucgaauacagaauaaugcuauccguccacggcucccaacacagcggaaugaucgucaacgacacaggacacgaaacagacgaaaaccgcgccaaaguagaaaucacccccaacucaccccgagcagaagccacucucggcggcuucggcucccuaggacuagacugcgaaccccgaaccggccuggacuuuuccgaccucuacuaccugaccaugaauaacaaacacuggcuaguacacaaagaaugguuccacgacauacccuuacccuggcacgccggcgccgacaccggcacaccccacuggaacaacaaagaagcccuggucgaguucaaggacgcacacgcaaaacgucaaaccguaguaguccucggcucccaagaaggcgccguccacaccgcccuagcaggggcacuagaagcagaaauggacggggccaaaggaagacuauccagcggccaccucaaaugccgacucaaaauggacaaacucagacucaaaggaguaucauacagccuauguaccgcagcguucaccuucaccaaaaucccagccgaaacacuacacgggacaguaaccguagaaguacaauacgccggaacugacggacccugcaaaguacccgcacaaauggcuguggacaugcaaaccuuaaccccagugggcagacugaucacagccaaccccguaauaacggaaucgacggaaaacuccaaaaugaugcucgaacuagacccucccuucggcgacucauacaucgucaucggcgucggcgagaaaaagaucacccaccauuggcaccgaagcggcagcacgauaggcaaagcauucgaagcaacaguaagaggcgccaaacgaauggccguccuaggagacaccgcaugggacuucggcagcguaggaggcgcacuaaacucacucggaaaaggaauccaccaaaucuucggagcagccuucaaaucccuauucgggggcaugaguugguucucccaaauacucaucggcacccuacuuauguggcucggccuuaacaccaagaacggaagcauaagccugaugugccucgcccugggcggcguccucaucuuccuuucuaccgcaguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7340 - RNA, 2449 nt, Artificial Sequence
  KU312314.1 prME-short mRNA Design 2 opt
ggggcgcugccuacggagguggcagccaucuccuucucggcaucaagcuuaccaugaccagcgugggaaucgucggacuacuccuaacaaccgcgauggcugccgaaguaacccgacgcgggagcgccuacuacauguacuuagacagaaacgacgcaggggaagcaaucagcuucccuacaacgcucggaaugaacaaaugcuacauacaaauaauggaccucggacacaugugcgacgcaacaaugaguuacgaaugcccaaugcuagacgaaggcguagaaccagacgacguagacugcuggugcaacaccacgagcacguggguagucuacgguacgugucaccacaagaaaggcgaagcacgacgcuccaggagagccguaacgcucccgagccacucgacacgaaaacuccaaacacgcagccaaaccuggcuagaaucacgagaauacacgaagcaccuaauccgaguagaaaacuggauauuccgaaaccccggauucgcgcucgccgccgcggccaucgcauggcuccuugggagcagcacaagccaaaaagugauauaccuaguaaugauccuacucaucgccccagcauacaguauacgaugcaucggagugagcaaccgcgacuucguggaaggaauguccgggggcaccugggucgacgucguccuggaacacggcggaugcgucacggucauggcacaagacaaaccaacaguggacauagaacucgucaccaccacagucagcaacauggcagaaguccgcagcuacugcuacgaagccagcaucucagacauggccuccgacagcagaugccccacccaaggcgaagcguaccuagacaaacaguccgacacgcaauacgucugcaaacggacacucguagacagaggauggggaaacggcugcggccuguucggcaaaggcucccuagucaccugugcaaaguucgccugcagcaagaaaaugacaggcaaaucaauccagccggaaaaccucgaauacagaauaaugcucagcguccacggcucccaacauagcggcaugauaguaaacgacacgggccacgaaacagacgaaaaccgagccaaagucgaaauaacacccaacagcccccgcgcggaagccacacucggaggcuucgggucgcuaggacucgacugugaaccaagaacaggccuggacuucagcgaccucuacuaccucaccaugaacaacaaacacuggcuugugcauaaagaaugguuccacgacauaccacucccguggcaugccggagcagacaccggaacaccacacuggaacaacaaagaagcccuaguggaguucaaagacgcacacgcaaaacgacaaacaguagucguacuaggaucccaagaaggcgcuguacacaccgcacuagccggcgcacuagaagccgaaauggacggagcaaaaggacgccuauccucaggccaccucaagugcaggcuaaagauggacaaacuccgauuaaagggagucuccuacagccugugcaccgccgccuucaccuucaccaaaaucccagccgaaacacugcacgggaccgugacaguagaaguacaauacgccggcacagauggacccugcaaaguacuagcacaaauggccgucgacaugcaaacacuaaccccagucggccgccucauaacggcaaaccccgugaucacagaauccacagaaaacucgaaaaugaugcuagaacucgacccacccuucggcgacucauacauaguaaucggaguaggagaaaagaaaauaacccaccacuggcacagaagcggaagcacaauaggcaaagccuucgaagcaaccguccgaggagccaaaagaauggcagucuuaggcgacaccgcaugggacuucgggagcgugggcggagcacuaaacagcuugggaaaaggaauccaccaaauauucggagcagcguucaaaagccuguucggaggcaugaguugguucagucagauccucaucggcacacuccucauguggcuaggacuaaacaccaaaaacggcagcaucucacugaugugccucgcgcucggaggcguacugauauuccugagcaccgccguauccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7341 - RNA, 2449 nt, Artificial Sequence
  KX446950.2 prME-short mRNA Design 2 opt
ggggcgcugccuacggagguggcagccaucuccuucucggcaucaagcuuaccaugaccucagucgggauugucggacuccuacucaccacagccauggcagccgaggugacccgacgaggaucagccuacuacauguaucucgaucgcaacgacgcaggcgaagccauaucguuccccacaacccucggcaugaacaaaugcuacauccaaaucauggacuuaggccauaugugcgacgccaccaugucauacgaaugccccacacuagacgaaggcgucgaacccgacgacgucgacugcuggugcaauaccaccuccacaugggucguauacggcacaugccaccacaagaaaggcgaagcccgccgaucccgcagagccguuaccuuaccaagccacuccacccgaaaacuccaaacgcggagccaaaccuggcuagaaagccgcgaauacacaaaacaccucauccgcgucgaaaacuggauauuccgcaacccaggauucgcccucgccgccgccgcaauagcauggcugcucggcuccagcacaucccaaaaagucaucuaccucguaaugauccuucucaucgcccccgccuacuccauccgcugcaucggcgucucaaaccgagacuucgucgaaggcaugucaggcggcaccugggucgacgucguccuggaacacggaggcugcguaaccgucauggcccaagacaaaccgacaguagacaucgagcuagugaccacaacagucagcaauauggccgaagucagaucuuacugcuaugaagcguccaucucugacauggccuccgacucacgcugucccacgcaaggggaagccuaccuggacaaacaaagcgacacgcaguacgucuguaaacgcacccuagucgaccgcggcuggggcaacggaugcggacuauuuggaaaaggcucacucgucacuugcgccaaauucgccugcucaaagaagaugaccggaaagucuauccaaccggaaaaccuagaauaccgcauaaugcuauccguccacgggucacaacacucaggaaugauagucaaugacaccggacacgaaaccgacgaaaaccgugcuaaaguagaaaucacccccaacuccccuagagccgaagcaacccuagggggauucggaagucuaggccuggacugcgaaccacgcaccggccuggacuucuccgaccucuacuaccucacaaugaacaacaagcacuggcuaguccacaaagaaugguuccacgacaucccacuaccuuggcacgccggcgccgacacaggcacaccccacuggaacaacaaagaagcccucguagaguucaaagacgcucacgccaaacgucaaaccgucgucguccuagggagccaagaaggcgcaguccacaccgcguuggcaggcgcccuagaagcagaaauggacggagcaaaaggacgacucuccucgggccaccuaaaaugccggcuaaaaauggacaaacuacgccucaaaggcgucuccuacagccucugcaccgcagccuucaccuucaccaagaucccagccgaaacccuucacggcaccguaaccguagaaguccaauacgcaggcacagacggcccaugcaaaguaccagcccaaauggcaguagauaugcaaacacuaaccccuguuggccgccucaucacagccaaccccguaaucaccgaaagcaccgagaacucaaaaaugaugcuagagcucgacccacccuuuggcgauuccuacaucgucaucgggguaggcgaaaagaaaaucacgcaccacuggcacagguccggaagcacaaucggcaaagcguucgaggcaacuguccgaggcgccaaacgaauggcaguccucggugacaccgccugggauuucggaagcgucggcggugcccucaauagccuaggcaagggcauccaccaaaucuucggcgccgccuucaaaucccuguucggaggcaugucaugguucucacagauccuaauaggcacccugcuaauguggcuaggccucaacaccaaaaacggaucgaucuccuuaaugugccuagcacucggcgggguccuaaucuuccuauccacagccguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7342 - RNA, 2449 nt, Artificial Sequence
  KY003157.1 prME-short mRNA Design 2 opt
ggggcgcugccuacggagguggcagccaucuccuucucggcaucaagcuuaccaugaccucgguagggaucgucggccuacuccuaacaacagccauggccgccgaagucacccgccgaggaagugccuacuacauguacuuagaccgaaacgacgccggggaggccauaucguuccccacaacacuaggaaugaacaaaugcuacauucagauaauggaccuaggacacaugugugacgcaaccaugaguuacgaaugucccaugcuggacgaaggaguagagcccgacgacguagacugcuggugcaacacaaccagcacuuggguagucuacggaacgugucaucacaagaaaggcgaagcacgacgaucccgaagggcuguaacgcugccaucacacucgacccgaaaacuucaaacacgaucgcaaacauggcuagagucccgcgaauacacaaaacaccucauacgcgucgaaaacuggauauuccgcaaccccggcuucgcccuggccgcagccgccaucgcauggcuccucggcagcaguaccucccaaaaagucaucuaccucguaaugauccuacuaaucgccccagcauacagcauacgaugcaucggaguaucaaaccgcgacuucgucgaaggcaugagcggcggaacauggguagacguaguauuagaacacggaggcugcguaacuguaauggcgcaagacaaaccgacaguagacaucgagcuagucaccaccaccgucaguaacauggcagaaguccggucauacugcuacgaagccagcauaucagacauggcguccgacagccggugccccacccagggcgaagccuaccuagacaaacaauccgacacccaauacgugugcaaaagaacccuaguagacagaggauggggcaacggaugcggccuauucgggaaagggucgcucguaacaugcgcaaaauucgccugcucaaagaaaaugacagggaaaucaauccaaccagaaaaccuagaauacagaaucaugcuaucuguccacggcucccagcacagcggcaugauagucaacgacacaggccacgaaaccgacgaaaacagggccaaaguagaaaucacaccaaacuccccacgcgccgaagcaacauuaggcggcuucggcagccuaggccucgacugcgagccccgaacgggccuugacuucuccgaccuauacuaccucaccaugaacaacaaacacuggcuuguacacaaagagugguuccacgacauaccccuacccuggcacgcaggcgccgacacaggcacaccccacuggaacaacaaagaagcccuggucgaguucaaagacgcacacgcaaaacgccaaacaguaguuguacucggaagccaggaaggcgcuguacacacagcccucgcaggagcucuggaagccgaaauggacggugcaaaaggccgacucucaagcggccaccugaaaugcagacuaaaaauggacaaacucagacucaaaggggugagcuacagccucugcacagccgcauucacauucacaaaaauaccagccgaaacccuucacgguacagucacaguggagguccaauacgcaggaacggacggaccaugcaaagugcccgcccaaauggcagucgacaugcaaacccucacgcccguagggaggcucauaacagcuaaccccguaauaacagagagcacggaaaacagcaaaaugaugcucgagcucgacccgcccuuuggggacagcuacauagucaucggcguaggagaaaagaaaaucacacaucacuggcaccgaagcggcucaacaauaggcaaagcguucgaagcaacaguacgaggcgccaaaagaauggcugugcucggagacaccgccugggacuucgguuccguaggcggagcacucaacucucugggcaaaggcauacaccaaaucuucggagcagccuucaaaucccucuucggaggaaugucaugguucagccaaauccucauaggaacacugcucauguggcucggacuaaacaccaaaaacggcagcauaucccuaaugugccuggcacuaggaggcguccuaauauuccucucuaccgugguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7343 - RNA, 2449 nt, Artificial Sequence
  KX811222.1 prME-short mRNA Design 2 opt
ggggcgcugccuacggagguggcagccaucuccuucucggcaucaagcuuaccaugaccagcguaggcaucgucgggcuacuacuaacaaccgcgauggccgccgaagucacacgcagaggguccgccuauuacauguaccuagacaggaacgacgccggcgaagcaauaucauucccgaccacgcuggggaugaacaaaugcuacauacagauaauggaccucgggcacaugugcgacgcaacaaugaguuacgaaugccccaugcuggacgaaggcguagaaccggacgacgucgacugcuggugcaacacaacgagugcauggguggucuacggaaccugccaccacaagaaaggcgaagcgcgcagaagccgccgagcagucacacuaccaagccacaguacacguaagcuccaaacaagaccacaaacauggcucgagucccgagaguacacaaaacacuuaauacgaguagagaacuggaucuucagaaacccaggauucgcacucgcagccgcagcaaucgcauggcuacuggguuccagcaccagccaaaaagucaucuaccucguaaugauacuccuaaucgccccggccuacuccaucaggugcaucggaguaagcaaccgcgauuucgucgaagggaugucgggaggaaccuggguagacgucguacucgaacacggcggcugugucacgguaauggcccaagacaaaccaacuguagacaucgagcuaguaaccacgaccguaucaaacauggccgaagucagaagcuacugcuacgaagcaucaaucagcgacauggccuccgacagcagaugccccacccaaggcgaagccuaccuggacaaacaaagcgacacacaauacguaugcaagagaacacuggucgaccgaggauggggcaacggcugcggccucuucgguaaagggucgcuaguuacaugcgccaaauucgcgugcagcaagaaaaugaccggaaaaagcauccaaccagaaaaccucgaauacagaaucaugcuauccguacacggcagccagcacagcggcaugauaguaaacgacaccgggcacgaaacagacgaaaacagggcaaaagucgagauaacacccaacucuccacgagccgaagcaacccucggaggauucgggagccucggacuagacugugaaccgaggaccggccuagacuucagcgaccuguacuacuuaacaaugaauaacaaacacuggcuuguacacaaagagugguuccacgacaucccccuaccauggcacgccggcgcagacaccggaacgccgcacuggaacaauaaagaggcccuaguagaguucaaagacgcccacgcaaaacgacaaacuguagucguccuaggcucacaagagggagcaguccauaccgcccuagccggagcgcucgaagcagagauggacggagcgaaagggcgccuaucaagcggacaccuaaagugcaggcuaaaaauggauaaacugcgccucaagggcgucagcuacucacucugcacagcagcauucacauucacaaaaaucccggccgaaacccuacacggaaccguaacaguagaaguacaguacgcaggaaccgacggacccugcaaagucccggcccaaauggcgguugacaugcaaacccuaacgcccguaggacgccugaucacagccaaccccguaaucacagaaucaaccgaaaauucaaagaugaugcuggaacuggacccgccauucggagacagcuacaucguaauaggggucggcgaaaagaaaauaacacaccacuggcaccgauccggaagcaccauuggaaaagcauucgaggccacagucaggggagcgaaacgaauggcaguccucggggauacagcaugggacuucggauccguaggcggagcccugaacucacugggcaaaggaauccaccaaauauucggagcagcguucaaaucacuauucggaggcaugagcugguucucacaaauacuaauaggcacacuacuaauguggcucggccuaaacacgaaaaacggcagcaucucccuaaugugccuggcccuaggaggcguacuaauauuccuaucaacagccguuuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7344 - RNA, 2449 nt, Artificial Sequence
  KX447516.1 prME-short mRNA Design 2 opt
ggggcgcugccuacggagguggcagccaucuccuucucggcaucaagcuuaccaugacaucagucggaaucgucggccucuugcuuacaacagccauggccgcggagguaacacgccggggcagcgccuacuacauguaccuagacagaaacgacgccggcgaagcaaucagcuuccccaccacacucgguaugaacaaaugcuacauccaaaucauggaccucggccacaugugcgacgccaccauguccuacgaaugccccaugcuagacgaaggcgucgaacccgacgacguagacugcuggugcaacaccaccagcacauggguggucuacggaaccugccaccacaagaaaggagaagcccgaaggagccgccgcgcagucacccuacccagccacucaacaagaaaacugcagacacgaagccaaacauggcuagaaucccgcgaauacacaaaacaccuaaucagagucgaaaacuggaucuucagaaauccaggcuucgcacucgccgcugcagcaauagcguggcuacucggcagcucaacaucaaagaaaguaaucuaccuaguaaugauccuacugauagcaccagccuacagcaucagaugcaucgggguauccaacagagacuucgucgaaggcaugagcggagggacguggguagacgucguccucgaacacggcggaugcgucaccguaauggcacaagacaaaccaacagucgacauagaacucguaaccacaaccgucucgaacauggccgaaguccgaagcuacugcuacgaagcgagcaucagcgacauggcaucagacucacggugcccaacccaaggagaagcauaccuagacaaacagagcgacacccaauacgucuguaaaagaacccucgucgaccgcggauggggcaacggcugcggccuauucggaaaaggaucacucguaaccugcgccaaauucgccugcuccaagaaaaugacaggaaaaaguauucagcccgaaaaccuugaguaccgcaucaugcugucgguccacggaagucaacacagcggcaugaucguaaacgacacuggacacgagaccgacgaaaaucgagcaaaagucgaaauaacaccgaacucaccccgcgccgaagccacccuuggcggauucggaucccucggccuagacugcgaacccagaaccggccuagacuucucggaccucuauuaucucacgaugaacaacaaacacuggcuuguccacaaagaaugguuccacgacauuccacuacccuggcacgcaggagcagacaccggcaccccacacuggaacaacaaagaagcccuaguggaguucaaagacgcccacgccaaacgccagacaguaguaguccuaggcucccaagaaggagccguccacacagcccuggccggcgcacuagaagccgaaauggacggggcgaaagggcgccuuaguagcgggcaucuuaaaugccgccuaaaaauggacaaacucagacucaaaggagucagcuauucccucugcacugcagcauucaccuucacuaaaaucccagccgaaacccuacacggcaccguaaccguggaaguacaauacgcgggcacagacggcccaugcaaaguacccgcccaaauggccguagacaugcaaacccucacaccagugggcaggcucauaacagccaaccccgucaucacggaaucgaccgagaacaguaaaaugaugcuggaauuagacccgcccuucggagauagcuacaucguaaucggaguaggagagaagaaaaucacacaccacuggcaccgaucaggcagcacaaucggcaaggcuuucgaggccaccguaagaggcgcgaaacgcauggcaguacuaggcgacacagccugggacuucggcucaguuggaggcgcccuaaacagccuaggcaaaggcauccaccaaaucuucggcgccgcauuuaaaagccuauucggcggaauguccugguucagccagauccugaucggaacucuccuaauguggcugggguuaaacaccaaaaacgggucgaucucacuaaugugccucgcacuaggcggaguacuaaucuuccugagcacagcagucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7345 - RNA, 2449 nt, Artificial Sequence
  KX520666.1 prME-short mRNA Design 2 opt
ggggcgcugccuacggagguggcagccaucuccuucucggcaucaagcuuaccaugacauccgucgggaucgucggccuccuacugacaaccgcuauggccgccgaagucacacgcagaggauccgcuuauuacauguaccucgaccgaaacgacgcaggcgaagcgaucaguuuccccacaacccucggaaugaacaaaugcuacauacaaaucauggaccucggacacaugugcgaugcgacgauguccuacgaaugccccauguuagacgaaggcgucgaacccgacgauguagacugcuggugcaacacaaccagcaccuggguaguauacggcacaugccaccacaagaaaggagaggcccgcagaucacgcagagcagucacacuacccagucacagcacgagaaaacuccaaacaaggagccagacauggcucgagagccgggaauacacaaaacaccuaauacgaguagaaaacuggaucuuccgaaacccaggauucgcgcucgccgccgccgccaucgccuggcuccucggcagcagcaccagacagaaaguaauauaccucgucaugauccuccuaauagcaccagcauauucaauacgaugcaucgggguaagcaaccgcgacuucguugaagggauguccggcggaacauggguagaugucguccuugaacacggcggcugcguaaccguaauggcccaagacaaacccacgguagacauagagcucguuacaacaaccguauccaacauggccgaagucaggagcuacugcuacgaggccagcauauccgacauggccagcgacagcagaugucccacacaaggagaagcguaccucgacaaacaaagcgacacacaauacguaugcaaacgaacccuagucgacagaggcuggggaaacggaugcggccucuucggcaagggcucccucguaaccugugcaaaguucgccugcuccaagaagaugaccggcaaaagcauacaacccgaaaaccuagaauaucgaaucaugcuaagcguacacgggagccaacacucaggcaugaucgucaaugacacaggccacgaaacagacgaaaacagggccaagguagaaaucacccccaacagcccccgcgccgaagccacccugggcggauucggcagccuaggccuagacugcgaacccagaacaggacuagacuucuccgaccucuacuaccucacaaugaacaauaaacauuggcugguacacaaggaaugguuccacgacauaccccucccuuggcacgccggagcagacaccggaacuccacacuggaacaacaaagaagcccuaguggaguucaaggacgcacacgcaaagagacaaacggucguaguacugggaucacaagaaggcgcaguccacaccgcccucgcgggagcacuagaagccgaaauggacggcgcaaaaggccgacuauccagcgggcaccuaaaaugcagacuaaaaauggacaaacuccgacuaaaaggagucaguuacagccuaugcaccgccgcauucacguucacaaaaaucccggccgagacgcugcacggcaccgucacgguugaagugcaauacgccggcacagacggccccugcaagguucccgcccaaauggccguagacaugcaaacgcuaaccccagucggccgccuuauaacggccaaccccguaaucaccgaaucaacagaaaacuccaaaaugaugcucgaacuagacccaccauucggcgacagcuacaucguaaucggcgucggcgaaaagaaaauaacgcaccacuggcaucgcagcggaagcacaaucggcaaagcguucgaagccaccguacgcggagccaaacgcauggccgugcucggcgacacagccugggacuucggaucagucggcggagcccuaaacagccucggcaaaggcauacaccaaauauuuggagcggccuucaaaucccuauucggagggaugagcugguucucccaaauccugaucggaacccuccucauguggcucggacucaacacgaaaaacggcagcauaagccuaaugugccuggccuugggcgguguacucauauuucuaagcaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7346 - RNA, 2449 nt, Artificial Sequence
  KU497555.1 prME-short mRNA Design 2 opt
ggggcgcugccuacggagguggcagccaucuccuucucggcaucaagcuuaccaugaccaguguagggauaguaggccuacuccucacaacggccauggcagcagaagucacccguagaggaagcgccuauuacauguaccuagaccgaaacgaugcgggcgaggccaucagcuucccaaccacucuaggcaugaauaaaugcuacauacaaaucauggaccucggacauaugugcgacgcgacaaugaguuacgaaugccccaugcuagacgagggcguagaaccagacgacguggacugcuggugcaauacaaccuccacaugggucgucuacggaacaugccaccacaagaaaggcgaggcccgacgcucgcgccgcgcuguaacauuacccucgcacuccacccgaaaacuccaaacacggagccaaacguggcucgaaagcagagaauacacaaaacacuuaauaagaguagaaaacuggauauuucgaaaccccggcuucgcccuagccgcggcagcgaucgcauggcuccuuggaagcagcacaagccagaaagucauauaccuagugaugauccuccucaucgcgcccgcauacucaauccggugcauaggcgucagcaacagagacuucguagaaggaaugagcggcggcaccugggucgacguagugcucgagcacggcggaugcgucaccguaauggcacaggacaaaccaaccgucgacaucgaacucgucacaaccacggucucaaacauggccgaagucagaucguacugcuacgaggccuccaucagcgacauggccagugacuccagaugccccacgcaaggggaagccuaccucgacaaacaaucagacacacaauacguaugcaaacgaacacucgucgacaggggauggggaaacggcugcggccucuucgguaaaggaucgcugguaaccugcgccaaauucgccugcagcaagaaaaugaccgggaaaagcauccaaccugaaaaccuagaauaccgcauaaugcucucaguccacgggucccagcacagcggcaugauagucaacgacacaggccacgaaaccgacgaaaacagggccaaaguagaaaucacccccaacagcccacgcgccgaagcaacgcuaggcggcuuuggaucccucggacuagacugugaaccacgaaccggccucgacuucuccgaccuauacuaucucaccaugaauaacaagcacuggcucgugcacaaagaaugguuccacgacaucccacucccauggcacgccggcgccgacaccggaacgccacauuggaacaacaaagaagcccuaguggaguucaaagacgcacacgcaaaaaggcaaacagucgucguacucggaacucaagaaggagcaguccacacagcgcucgcaggagcacucgaagcagaaauggacggggcaaagggcagacuauccagcggacaccucaagugccggcucaagauggacaaacuacgccuaaaaggcguaagcuacagccuaugcaccgcagccuucaccuucaccaagauacccgcagaaacccuacacggcacagucacaguggaaguccaauacgccggcaccgacggacccugcaaaguccccgcccaaauggcagucgacaugcagacgcucacacccguaggacguuuaaucacagcgaaccccguaauaaccgagucaaccgaaaacagcaaaaugaugcuagaacucgacccaccauucggcgacaguuacauagucaucggcguaggcgagaaaaagauaacccaccacuggcaccgaagcgggagcacaauaggcaaagccuucgaagcaaccguccgaggagccaaaagaauggccguccuaggagacaccgccugggauuucgggagcgucggcggggcacucaacagccucggaaaaggcauacaccaaauauucggggcagcauucaagagcuuguuuggagggaugucaugguucucccagauccucaucggcacccuacucauguggcuaggacuaaacaccaaaaacgggucgaucucacucaugugccuagcccucgggggcguacuuaucuuccuaucaacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7347 - RNA, 2449 nt, Artificial Sequence
  KY075939.1 prME-short mRNA Design 2 opt
ggggcgcugccuacggagguggcagccaucuccuucucggcaucaagcuuaccaugacgagcgucggcaucguaggacuacuccucacuaccgccauggcagccgaagucacaagacgaggauccgccuacuacauguaccuagaccgcaacgacgcaggcgaagcaauauccuucccaaccacgcuggguaugaacaaaugcuacauacaaauaauggaccucggacacaugugcgacgcaacaaugucguacgaaugcccgaugcuagacgaaggaguagagccagacgacgucgacugcuggugcaacacaaccuccacgugggucguguacggcacaugccaccacaaaaagggagaggcccgaagaagccgacgagccguaacccuccccucacacucgacccgcaaacuucagacacgcagccaaacauggcuagaaagcagagaauacaccaagcaccugaucaggguagaaaauuggauauuccgcaaccccggauuugcccuagcagccgcagccaucgcauggcuccugggauccagcacaucacagaaaguaauauaccuuguaaugauccuacuaaucgcaccagccuacucccuccggugcauaggcgucagcaaccgcgacuucgucgaaggcaugucaggcgggaccuggguagacguaguacucgaacaugggggaugcgucaccguaauggcacaggacaaaccaaccgucgacaucgagcugguaaccacaacaguaagcaacauggcagaagugcgcucauacugcuacgaagcauccaucagcgacauggccagcgacucccgcugcccaacacaaggcgaagccuaccuagacaaacaaagcgacacccaauacgucugcaagagaacccucguagaccgaggcugggguaacggcugcggacucuucggcaaaggcucacucgugacuugcgccaaguucgcaugcagcaagaaaaugacaggcaaaagcauacaaccagaaaaccuagaauacagaaucaugcucagcguucacggaucccaacacuccgggaugaucgucaacgacacaggccacgaaacagacgaaaaccgcgcaaaagucgaaaucacaccaaacagcccacgcgcagaagcaacacuuggcggauucggcagccucgggcuagacugcgaaccccgaacgggccuggacuucagcgaccuauacuaccuaaccaugaacaacaaacacuggcuaguccacaaagaaugguuccacgacaucccccucccauggcacgccggagccgacacaggaacaccccacuggaacaauaaagaagcccuaguagaguucaaagacgcccacgccaaacgccaaacaguaguaguucuagggagccaagaaggagcaguccacacagcgcucgcaggcgcccuggaggcagaaauggacggagccaaaggacggcucuccagcggacaccuuaagugccggcuaaaaauggacaaacucagacucaaaggcguaucuuacaguuuauguaccgccgccuuuacauucaccaagauccccgcugaaacacuucacgggaccgucacagucgaaguccaauacgcggguaccgacggaccaugcaagguccccgcgcaaauggcaguagacaugcagacauuaacacccguaggccggcuuaucacagcaaacccaguaaucacagaaucaacagaaaacucaaaaaugaugcucgagcuagacccgcccuucggggacucauacaucgucaucggagucggagagaaaaagaucacacaccacuggcaccgcagcggcagcacgaucggaaaagcguucgaagccacugugcgcggagcgaaaagaauggcaguacugggagacacugcgugggacuucggcucagucggaggggcacuaaacagccugggcaaaggaauacaccaaauauucggcgcggcauucaaaucccucuucggaggaaugaguugguucucacaaauccugaucggcacccuacucauguggcugggucucaacaccaaaaacgggucaauaagccucaugugccucgcacuaggcggaguacuaaucuuccucaguacagcaguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7348 - RNA, 2449 nt, Artificial Sequence
  KY075932.1 prME-short mRNA Design 2 opt
ggggcgcugccuacggagguggcagccaucuccuucucggcaucaagcuuaccaugaccuccgucgggauaguaggccuacuacucaccaccgcuauggcagcagaaguaacccgaaggggcagcgcauauuacauguaccuagacagaaacgacgccggcgaagcgaucaguuucccgacaacgcugggaaugaacaaaugcuacauacaaaucauggaccucggacacaugugugacgccaccaugucauacgaaugcccgaugcucgacgagggagucgaacccgaugauguagacugcuggugcaacacaacaagcacuugggucgucuacgggaccugccaccacaagaaaggcgaagcacgucgcagccgcagagcuguaacccucccaucgcacagcacacgcaaacuccaaacccgcucccaaacguggcuggaaucccgcgaguacaccaaacacuuaaucagaaucgaaaauuggaucuuccgcaaccccggcuucgcacucgcggcagccgccauagcguggcuccuaggcucauccacgagucaaaaaguaauauaccucgucaugauccuacuaauagcccccgccuacuccauacgcugcauaggcgucagcaaccgagacuucguagaaggaaugucuggaggcaccugggucgacguaguacuggaacacggcggcugcgucacggugauggcacaagacaaaccgaccguagacaucgaacucgucaccaccacaguaagcaacauggcugagguccgcucguacugcuacgaggcaagcauaagcgacauggcaucagacuccaggugccccacccaaggagaagccuaccucgacaaacaaagcgacacccaauauguaugcaaaaggacccuagucgaccgcggguggggaaacggcugcggacuauucggcaaaggaagccucguuaccugcgcaaaauucgcaugcuccaagaaaaugaccggcaaaucuauacaaccagaaaaccucgaauacagaauaaugcuaucaguccacggcucacaacacagcggcaugaucgucaaugacaccggccacgaaaccgacgaaaacagagcaaaaguagaaaucacccccaacagcccacgagccgaggccacccucggcggcuucggaucgcuggggcuagacugcgaacccagaacaggccucgacuucucugaccuauacuaccuaacgaugaacaacaaacacuggcucguccacaaagaaugguuccacgacaucccacuaccauggcacgcaggcgcagacacaggaacaccccacuggaauaauaaagaggcacuugucgaguucaaagacgcacacgccaaaagacaaaccgucguaguccucggcagccaagaaggugcuguacacaccgcacucgccggcgcccucgaagcagaaauggacggcgcaaaaggccgccuaucaucaggccaccuaaaaugccgccucaaaauggacaaacuccgacuaaaaggcgucagcuacucgcucugcaccgcggccuucaccuucaccaaaauccccgcagaaacccuacacggaaccgugaccgucgaaguccaauacgcaggaaccgacggaccaugcaaagucccagcacaaauggccgucgacaugcagacacuaacaccaguaggcagacucauaacugccaacccaguaaucacagaauccaccgaaaacaguaaaaugaugcucgaacuagacccgccauucggcgacagcuacaucgucaucggcgucggggaaaagaaaaucacacaucacuggcaccgcucaggauccacaaucggcaaagccuucgaagccacaguccgaggggcuaaaagaauggcaguccucggcgacaccgcaugggacuucggcagcguaggcggcgcccuaaacucacucggaaaaggcauucaccaaauauucggcgcagcauucaaaucacuuuucggaggaaugagcugguucucacaaauacuaaucggaacacuacuaauguggcucggacucaacaccaaaaacggguccauaagccugaugugucuagcccuaggaggaguacucaucuuccuaagcaccgcagucuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7349 - RNA, 2449 nt, Artificial Sequence
  KU870645.1 prME-short mRNA Design 2 opt
ggggcgcugccuacggagguggcagccaucuccuucucggcaucaagcuuaccaugacaucagugggaauaguaggacuccuacuaacgaccgcaauggccgcagaaguuacccgaagaggcagcgcauacuauauguaccucgaccgcaacgacgccggcgaagccaucucauucccaaccacacucgggaugaacaaaugcuacauccaaauaauggaccuaggacacaugugcgacgcgaccaugucauacgagugucccaugcuugacgaaggcguagaaccggacgacguagacugcuggugcaacaccacgagcaccugggugguauacggcaccugccaccacaaaaaaggcgaggcgagaaggagcagacgagccgucacccuucccagccauucaacccgaaaacuacaaacaagaagucaaacguggcuagaaucacgcgaauacacaaaacaccugauccgcguagaaaacuggauccuaaggaacccaggauucgcacuggccgccgcggccaucgccuggcuccuagggagcagcacaucccaaaaaguaaucuaccuagucaugauccuccugauagcgcccgcguacagcaucagauguaucggcgucuccaaccgagacuucguagaaggaaugucuggggguacaugggucgacgucguccuagaacacggcggcugcgucacaguaauggcacaagacaaaccaacgguagacauagaacucgugaccaccaccgucucaaacauggcagaaguacgaucguacugcuacgaggcguccauaucagacauggccagcgacagccgcugcccaacccagggagaggcauaccucgacaaacaauccgacacccaauacgugugcaaaaggacacuagucgaccgggggugggggaacggcugcggccucuuuggaaaaggcagccucgucacaugcgccaaauucgccugcuccaaaaaaaugacagggaaaagcauccaaccagaaaaccuagaauaccgaaucaugcucuccgugcacggcucacaacacuccgggaugauaguaaacgacacaggacacgagaccgacgaaaaccgagccaaaguugaaauaacccccaacagccccagagcugaagccacacuuggaggauucggaucccuaggccucgacugcgaaccacgcacgggccucgacuuuagcgaccuauacuaccuaaccaugaacaacaaacacuggcugguccacaaagaaugguuccacgacaucccgcugccauggcacgccggcgccgacacgggaaccccccacuggaacaacaaagaggcacucgucgaauuuaaagacgcacacgccaaacgacaaaccgucguuguacuaggcucacaagagggcgcgguccauacagcacuagcaggcgcccuggaggccgaaauggacggagccaaaggccgacucuccagcggacaucuaaaaugccgacugaagauggauaaacuacgacucaaaggagucucauacucacuauguaccgcagcauuuacauucacaaaaauacccgcagaaacacuacacggaaccguaaccgucgaaguccaguacgccggcacggacggccccugcaaaguccccgcccaaauggccgucgacaugcaaacacugaccccagucggccgccucauaaccgcaaacccagucaucacugaauccaccgagaacagcaaaaugaugcucgagcucgacccccccuucggcgacagcuacaucgucaucggcaucggggaaaagaaaauaacacaccacuggcaccgauccggcagcaccaucggcaaagccuucgaggcaacaguccgcggagcaaaacgcauggcaguccucggagacaccgccugggacuucggcagcgucggaggagcccucaacucucugggcaaagggauacaccaaaucuucggagcagcauucaaaagccuauucggcggaaugagcugguucucccaaauacucauaggaacccuccucauguggcucggacuaaacaccaaaaacggauccauaagccuaaugugccuagcucucggaggcgugcuaauauucuuaaguaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7350 - RNA, 2449 nt, Artificial Sequence
  KU729217.2 prME-short mRNA Design 2 opt
ggggcgcugccuacggagguggcagccaucuccuucucggcaucaagcuuaccaugaccuccguaggaaucgucggccuccugcuaaccaccgccauggcagccgaagucacacgccgcggcucagcauacuacauguaucucgacagaaaugacgccggugaagccauaucauuccccaccacacugggcaugaauaagugcuacauccaaaucauggaccugggccacaugugcgacgccacaauguccuacgaaugucccaugcucgacgaaggcgucgagcccgacgacguagacugcuggugcaacaccacuagcacgugggucgucuacggaaccugccaccacaagaaaggcgaagcccgccgaucaagaagggcagucacccuucccucacacagcacccgaaaauuacaaacaagaagccaaacauggcucgaaagccgcgaauacacaaaacaccuuauccgcguagagaacuggaucuuccgcaaccccggcuucgcccucgccgccgccgccaucgccuggcuacuuggcucauccaccagccaaaaagucaucuaccuagucaugauccuacucaucgcacccgccuacuccauccgaugcaucggcguauccaaccgcgacuucgucgaaggaaugaguggcggcaccuggguagacguuguccucgaacacggcggaugcguaaccgucauggcccaagacaaaccgaccgucgacauagaacucgucucaaccaccguaagcaacauggcagaaguaagaucauacugcuacgaagcaaccauaagcgacauugcgucggacucccgcugcccaacucagggcgaagccuaccuagacaaacaaucagacacccaauacgugugcaaacgaacccucguggauagaggcuggggcaaugggugcgggcuuuucgggaaaggcucccuggucacaugcgccaaauucgccuguagcaagaaaaugacaggcaaauccauccaaccggaaaaccucgaauaccgcaucaugcuaucaguacacggcagccaacacagcggcaugauuguaaacgacacaggacacgaaaccgaugaaaaccgagccaaagucgaaauuacccccaacucaccccgcgccgaggcaacccuuggaggcuucggcucccucggacuggacugcgaaccaagaacaggccucgacuuuuccgaccucuacuaccuaaccaugaacaacaaacacuggcucguacacaaggaaugguuccacgacaucccccuucccuggcacgcgggagcggacaccggcaccccacacuggaacaacaaagaagcgcuggucgaguucaaagacgcccaugccaaacgccaaacagccgucgugcucgggagccaagaaggagcaguucacaccgcccuagccggcgcccuggaagcagaaauggacggcgccaaagggcgacucuccuccggccaccucaaaugccgacuaaagauggacaaauuacgccuaaaaggagucuccuauagccuaugcacagccgcauucacauucacaaagauacccgcagaaacccuccacggcaccguaaccgucgaaguacaauacgcaggaacggacggaccaugcaaaguacccgcccaaauggcagucgacaugcaaacccuaacccccgucggacgacucauaaccgccaacccagucaucacagaaagcaccgaaaacucaaaaaugaugcucgaacucgacccacccuucggcgacucauacaucgucaucggcgucggagaaaagaaaauaacccaccacuggcaccgcuccggcagcacgaucgggaaagcauucgaagccacaguccgaggagccaagcgaauggcaguccuaggcgauacagccugggacuucggcucaguagguggcgcccuaaacucacucggaaagggaauccaccaaauauuuggcgccgcauucaaaucccuauucggcggcauguccugguucagccagauauuaauaggaacacuacucauguggcuagggcucaauaccaaaaacggcuccaucucgcuaaugugccuagcccucgguggcguacucaucuuccucagcaccgcagucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7351 - RNA, 2449 nt, Artificial Sequence
  KX087101.3 prME-short mRNA Design 2 opt
ggggcgcugccuacggagguggcagccaucuccuucucggcaucaagcuuaccaugacaagcguuggaaucguaggacuacuacugaccaccgccauggcugccgaagucacacgccgaggcucagccuacuacauguaccucgaccgaaacgacgccggugaagcaauaucauucccaaccacacucggcaugaacaaaugcuacauccaaaucauggaccucggacacaugugcgacgccaccaugagcuacgaaugucccaugcuagaugagggcgucgaaccagacgaugucgacugcuggugcaacaccaccuccaccugggucguguacgguaccugccaccacaagaaaggcgaagcccgacgaucacgacgcgcagucacacucccaagccacagcaccaggaaacuccaaacacgcagccagacauggcucgaaagccgcgaauauacaaaacaccuaauaagaguagaaaacuggaucuuccgaaacccaggcuucgcccucgcagccgccgcgaucgcauggcuacucgggagcucaaccucccaaaaagucaucuaccuaguuaugauacuacuaauagcacccgcuuacuccauccgaugcauaggcgucucaaaccgcgacuucgucgaaggaaugagcggaggcaccuggguagacguaguccucgagcacggagguuguguaaccgucauggcucaagacaaaccaacggucgacauagagcuaguaacaacaaccgucucaaacauggcagaaguccggagcuacugcuacgaagccagcaucuccgacauggccucugauucccgcugcccaacacaaggcgaggcuuaccuagacaaacagucagacacccaguauguuugcaaacggacacucgucgaccgaggguggggcaacggaugcggccucuucggcaaaggcucccucguaacaugcgcaaaauucgcuuguucaaagaaaaugacaggcaaaucaauccaaccggagaaccucgaauaccgcaucaugcucagcguccacgggagccaacacuccggaaugauagucaacgacaccggacacgaaaccgacgaaaaccgagcaaaaguggaaaucacgccuaacagcccccgggccgaagcaacccuaggaggcuucgggucccuggggcuugacugcgaaccucguaccggccuagacuucagcgaccucuacuaccuaaccaugaacaacaaacauuggcuaguacacaaagagugguuccacgacauccccuuacccuggcacgccggagcagacaccggcacaccccacuggaacaacaaagaagcccucguugaguucaaagacgcacacgcaaaacgccaaaccguagugguucuaggaucccaagaaggagccguccacaccgcccucgccggagcacucgaagccgaaauggacggcgcaaaaggcaggcucagcagcggacaccucaaaugccgacuaaaaauggacaaacuccgacucaaaggcguguccuacucccugugcacagccgccuucaccuucaccaaaauccccgccgaaacacuccacggcacgguaacaguagaacuacaauacgccgggacagauggaccaugcaaaguccccgcacaaauggcaguagauaugcaaacacuaacccccguaggccgccuuaucaccgcaaaccccgucaucaccgaauccacagaaaacuccaaaaugaugcuugaacucgacccaccauucggcgauucauacaucgucauaggcgucggagaaaagaaaaucacgcaccacuggcacaggagcggcuccaccauaggcaaagcguuugaagccaccgugcgcggcgccaaacgaauggcaguccucggagacacagccugggacuucggcuccguuggcggggcacuaaacucacucggcaaaggcauccaccaaaucuuuggagccgcguucaaaucacucuucgguggcaugucuugguucucucagauccuaaucggcacucuucucauguggcuaggacucaauaccaaaaacggcucgaucagccucaugugccucgcacucggcggcguacucauuuuccucagcacagccgucucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7352 - RNA, 2449 nt, Artificial Sequence
  KY014317.1 prME-short mRNA Design 2 opt
ggggcgcugccuacggagguggcagccaucuccuucucggcaucaagcuuaccaugacauccguaggaaucgucggacuccugcucacaaccgccauggccgccgaagucacaagacgaggcuccgcauacuacauguaccucgaccgcaacgacgccggcgaggcaaucagcuucccaaccacccucggcaugaacaaaugcuacauacaaauaauggaucuaggacacaugugcgacgccacgaugagcuacgaaugccccaugcuggacgaaggaguggagccagacgacgucgacugcuggugcaacaccacaagcacauggguuguauacggaaccugccaccacaagaaaggcgaggcccgccgcagcagacgagcaguaacucuaccaucccacuccacacgcaaacuccaaacucgaucccagaccuggcucgaaagccgagaauacacaaaacaucucauacgcgucgaaaacuggauauucagaaacccaggguucgcacucgccgccgccgccaucgccuggcuccuaggcagcagcacaucccaaaaagucaucuaccuaguaaugaucuuauuaauagcccccgcguacuccauacggugcaucggaguaucaaaccgagacuucguagaaggaaugagcgggggcacgugggucgacguuguccucgaacacggcggcugcguaaccguaauggcccaagacaaaccaacaguagacauagaacucgucaccacaaccgucagcaacauggccgaagugcgcucauacugcuacgaagccuccauuuccgacauggccucugacaguaggugcccaacgcagggagaagcauaccuagacaaacaaagcgacacccaauacgucugcaagcgcacucuagucgaccgaggauggggaaacgggugcggucuauucggaaaaggcagucuuguaaccugcgcaaaauucgcuugcuccaagaaaaugacaggcaaaagcauacaacccgaaaaccucgaauaccgcaucaugcucuccguccacggcucacaacacucagggaugaucgucaaugacacaggccaugaaaccgacgaaaaccgggccaaagucgaaaucacccccaacagccccagagccgaagcaacccuaggaggcuucggcagccuaggccucgacugcgaaccucgcaccggucuggacuucuccgaucucuacuaccucaccaugaacaacaaacauuggcucguccacaaagaaugguuccacgacaucccccucccauggcacgccggagccgacacaggaacaccacauuggaacaacaaagaagcacuggucgaguucaaagaugcccaugccaagagacagaccgucgugguccucggcucacaagaaggcgccguacacaccgcacucgccggagcgcucgaagccgaaauggacggagccaaagguaggcuaagcuccggacaccugaaaugcagacuuaaaauggacaaguuacgccucaaaggcgucucauacucccuuugcacagccgcauucacuuucacaaaaauccccgccgaaaccuuacacgggacaguaacuguggaagugcaauacgccggcaccgacggaccgugcaagguccccgcgcaaauggcagucgacaugcaaacacuaacacccguaggccgccugaucacagcaaacccuguuaucacagaaucaauagaaaacuccaaaaugaugcuugaacucgacccaccguucggagacagcuacaucguaauaggcgucggcgaaaagaaaauuacccaccacuggcaccgcucaggcagcacaaucggaaaagccuucgaagccacaguccggggcgccaaacgaauggccguccucggcgacaccgcaugggacuucggaucaguaggaggcgcacucaacagucuugggaaaggaauccaccaaauauucggagccgccuucaagagccucuucggaggcauguccugguuuagccaaauacuaauaggcacacuccuaauguggcuaggccucaacaccaagaacggcagcaucagccucaugugccucgcccucggaggaguacuaauauuccuauccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7353 - RNA, 2449 nt, Artificial Sequence
  KU758876.1 prME-short mRNA Design 2 opt
ggggcgcugccuacggagguggcagccaucuccuucucggcaucaagcuuaccaugacaaguguaggaaucgugggucuccuccugacaaccgcaauggccgcagaaguaacacggcggggguccgcauacuacauguaccucgaccggaacgacgcaggcgaggccaucucuuuccccaccacccuaggcaugaacaaaugcuacauccaaauaauggaccuaggacacaugugcgacgcaaccauguccuacgaaugccccaugcuagaugaaggagucgaaccagacgacguggacugcuggugcaacaccaccaguaccugggucgucuacggaacaugccaccacaagaaaggggaggcucgcagaagccgccgagcugucacacucccaagccacagcaccagaaaacuccaaacacgaucccaaacauggcuagaaucgcgcgaguacaccaaacaccucauccgcguggaaaacuggaucuuccgaaacccaggcuucgcccucgcagcggcagcaauagcauggcuguuaggauccuccacaagccaaaaaguaauauaccugguaaugauccuacucaucgcacccgcauacuccauccgaugcauaggaguauccaaccgggacuucgucgaaggaaugagcggaggaaccugggucgacgugguccuagaacacggcggaugcgucaccgucauggcacaagacaaacccacaguggacaucgagcuaguaaccaccaccgugucaaacauggcugaaguuagauccuacugcuacgaagcaagcaucagcgacauggcgagugacagcagaugccccacacaaggcgaagcauaccucgacaaacaauccgauacccaauacguaugcaaacgcacacucguagaccgcgguuggggcaacggcugcggauuauucgggaaagggagccucguuaccugcgcaaaauucgccugcagcaaaaagaugacaggcaaaagcauccaacccgagaaucuagaauacagaauaaugcucuccguacacggaucccaacacucagggaugauaguuaaugacacaggccacgaaacagacgaaaaccgagccaaaguugaaauaaccccgaacucaccaagagccgaagccacccuaggaggcuucggaucucucggacucgacugcgaaccccgcacaggacuagacuucuccgaccuauacuaucucacuaugaacaacaagcacuggcucguacauaaagaaugguuccacgacaucccacuacccuggcacgcgggcgcagacacagggacgccccacuggaacaauaaagaagcgcucguagaguucaaggaugcucacgccaagcgccaaacagucguaguacuaggcucccaagaaggcgccguccacacagcccuagcaggagcccuggaagccgaaauggacggaguaaagggcagacucucuagcgggcaccuuaaaugccgacugaaaauggacaaacucagguuaaagggcguauccuauucacugugcaccgcggcauucacauucaccaaaaucccggccgaaacacuccacggcacaguaacggucgaaguccaauacgccggcacggacggacccugcaaaguacccgcccaaauggcagucgacaugcaaacccucacacccgucggaaggcuaauaacagccaaccccgucaucaccgaaagcaccgaaaacagcaaaaugaugcucgaacuagacccacccuucggcgacucauacauagugaucggcgucggcgaaaagaaaaucacgcaccacuggcacagaucaggaucgacaauaggaaaagccuucgaagcgacaguccgcggagcaaaacgaauggccguauuaggggacacagcaugggacuucggcuccgucggcggcgcacucaacucccucgguaaaggaauacaccaaauauucggugcagcuuucaaaucacuauucggcggcauguccugguucagccaaauucucaucggaacacuccucauguggcucggccuuaacacuaaaaauggcucaaucucguucaugugccucgcccuaggcggaguccugaucuuccucuccaccgcgguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7354 - RNA, 2449 nt, Artificial Sequence
  KU758874.1 prME-short mRNA Design 2 opt
ggggcgcugccuacggagguggcagccaucuccuucucggcaucaagcuuaccaugacaagcguaggaauagucggacuacuacucacaacggcaauggcagccgaagucacccgaagagggagcgccuauuacauguaccuagacagaaacgacgcaggagaagcaaucucauuccccacgacacucgggaugaacaaaugcuacauacaaauaauggaccuaggacauaugugcgacgcgacaaugucauacgaaugcccaaugcucgacgaaggaguggaacccgacgacguagacugcuggugcaacaccacauccaccugggugguauauggcacaugccaccacaagaaaggcgaagcacgccgaagccgccgagcagucacacucccaagccacagcacccgcaaacuccagacaagaagccaaacauggcuagaaucccgagaauacacuaaacaccuaauacggguagaaaacuggauauucagaaacccaggauucgcacuugcagccgcagccaucgcuuggcuccuaggaagcuccacgucccaaaaagugaucuaucucgucaugauacuacugaucgcccccgccuacagcauacgcugcauaggcguaagcaaccgagauuucguggaaggaaugagcggcggcaccuggguagacgucguucuagaacacggaggcugcguaaccguaauggcccaagacaaacccaccguggacaucgaacugguuacaaccaccguauccaacauggccgagguuagaagcuacugcuacgaagcguccaucucagacauggccucagacucacgcugccccacacaaggagaagcauaccucgacaaacaaucagauacgcaguacgucugcaaaagaacacugguggaccgcggcuggggaaacggaugcggccuguucgguaaaggcagccucgucacaugcgcaaaauucgcgugcucgaaaaagaugacaggcaaaagcauacaacccgaaaaccuagaauaccgaaucaugcuauccguccacggcucacaacacucuggaaugaucgucaacgacacgggccaugaaacggacgaaaacagagccaaagucgagauaacacccaacagccccagggccgaagcgacacucggaggcuucgguagccugggacuagacugcgaaccgcgcacaggccuggacuucagcgaccuuuacuaccugaccaugaauaacaaacacuggcucguccacaaggaaugguuccacgacaucccccugccauggcaugccggcgcagacaccggcaccccacacuggaacaacaaagaagcccuaguagaguucaaagacgcacacgcaaaacgccagacaguaguaguccugggcucacaggaaggcgcagugcacaccgcacuggcaggcgcgcuggaagccgagauggacggcgccaaagguaaacuaucuucgggccaccucaaaugccgucuaaaaauggacaaacuaagacuaaaaggggucuccuacagccucugcaccgcagccuucaccuuuacaaaaauaccagcagaaacacuccacgggacaguaaccgucgaagugcaguacgccggcacagacggccccugcaagguccccgcacagauggcagucgacaugcagacacucaccccaguaggacgccucauaaccgcaaaccccgucaucaccgaaagcaccgagaacaguaaaaugaugcucgaauuggacccaccauucggagacagcuacaucguaauaggaguuggcgaaaagaaaaucacacaccauuggcacagaagcgggagcaccauaggcaaagcauucgaagccacgguccgaggcgcaaaacggauggcagugcuaggcgacaccgcaugggacuuuggaagcgugggcggagcacugaacagucuaggaaaaggcauacaccagauauucggagcagcguucaaaagccuguuuggcggaaugucaugguucucgcaaauccucauaggcacccuacuuauguggcuagggcucaacaccaaaaauggaagcaucagccuaaugugccuagcacuagggggcguccuaauauuccucagcaccgccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7355 - RNA, 2449 nt, Artificial Sequence
  KY317939.1 prME-short mRNA Design 2 opt
ggggcgcugccuacggagguggcagccaucuccuucucggcaucaagcuuaccaugacgagcgucggaaucgucggacuccuccuaaccaccgcaauggcggccgaagucacccgccgaggcagcgcauacuacauguaccuagaccgaaaagacgccggagaagcgaucagcuuccccaccacacuaggaaugaacaaauguuacauacaaaucauggaucugggacacaugugcgacgccaccaugagcuacgaaugccccaugcucgacgaaggcguagaaccggacgacguagacugcuggugcaacaccaccagcaccugggucguauacggaaccugccaccacaagaaaggagaagcacggcgaagccgacgcgccgucacacuccccucacacagcacccgcaaacuccaaacccgaucccaaaccuggcucgagagcagagaauacacgaaacacuuaauacgaguagagaacuggauauuccgcaaccccggauucgcacuagcagcagccgccaucgccuggcuacucggcucauccacaucacaaaaagucaucuaccuggucaugauacuacuaauagcacccgccuacagcauacgcugcauaggaguaagcaaccgcgacuucgucgaaggaauguccggcggcaccuggguagacguaguccuggagcacggcggcugugucaccguaauggcacaagacaaacccaccguagacaucgagcuaguaacaaccaccgucaguaacauggcagaaguacgauccuacugcuacgaagcaagcaucuccgacauggcgucagacucccggugucccacgcaaggagaagcauaccucgacaagcaaagcgacacacaauacgucugcaaacgaacccucgucgaccgaggauggggcaacgguugcggccuguucggaaaaggaucccucgugaccugcgcaaaauucgcaugcagcaagaaaaugaccggcaagagcauccaacccgaaaaccuagaauaccgcaucaugcugucaguccacggcagccaacacagcgggaugauagucaacgacacuggccacgaaaccgacgaaaacagagcaaaaguggagauaaccccaaacagcccccgagccgaggcaacacucggaggauucgggagccucggccucgacugcgaacccaggaccggacucgacuucagcgaccucuacuaccugaccaugaacaacaaacacuggcucguccacaaagaaugguuccacgacauaccucugccuuggcacgcaggcgccgacacgggaacuccacacuggaacaacaaagaagcccucguagaguucaaggacgcccacgcgaaaaggcaaacgguaguuguacuaggcagucaagaaggcgcaguacacaccgcccuagccggcgcccuagaagccgaaauggacggcgccaaaggccgucuauccagcggacacuuaaagugccgacuaaaaauggacaaacuucgccucaaaggggucucauacagucucugcaccgcugcguuuaccuucaccaaaauccccgcagaaacacuccacggaacugucacagucgaagugcaauacgccgggacagacggccccugcaaaguaccagcacagauggccgucgacaugcagaccuuaacaccugucggaagacucaucacagccaaccccgucauaaccgaauccacagaaaacagcaaaaugauguuagaacucgacccucccuucggagacucauacauaguaaucggcgugggcgaaaagaaaaucacccaccacuggcacagauccggauccaccaucggaaaagccuucgaagccaccguccgaggcgccaaacgcauggccguauugggagacacagcaugggacuucggguccguaggaggcgccuuaaacucgcuagggaaaggcauccaccaaaucuucggagccgccuucaaaagccucuucgguggcaugagcugguucucccaaauccucaucggcacgcuccuaauguggcuaggucugaacaccaagaacggcucaauaucccuaaugugccucgcacuaggcggaguccuaauauuccuaucaaccgccgucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7356 - RNA, 2449 nt, Artificial Sequence
  KY014314.1 prME-short mRNA Design 2 opt
ggggcgcugccuacggagguggcagccaucuccuucucggcaucaagcuuaccaugaccuccgugggaaucguaggacugcuacucacaacagccauggcagcagaagucacccgaagaggcucugcguacuacauguaccuagaccgcaacgacgccggggaagcgauaucauucccaacaacacucggcaugaacaaaugcuacauccaaauaauggaccuaggccacaugugcgacgccacaaugagcuacgaaugcccaaugcucgacgaaggaguggagccagaugauguggacugcuggugcaacacgaccucaaccuggguaguauacggcacaugccaccacaaaaagggcgaggcccgcagaagccgcagagcagucacccuacccucacacucuacaagaaaacuacaaacacgcucccaaacauggcuagaaagcagagaauacacaaaacaccuaauacgaguagagaacuggaucuuccgaaacccaggcuucgcauuggcagccgccgcaaucgcuuggcuacuaggguccagcaccagccaaaaagucaucuaccuaguuaugauacuccucaucgccccagccuacagcauccgaugcauugguguaucaaacagggacuucguagaaggaaugagcggcggaacauggguagacgugguccucgaacacggcggcugcguaacgguaauggcccaagacaaacccacaguagauauagagcuagucacaacgacaguaagcaacauggccgaaguaagaagcuacugcuacgaagcaagcauaagcgacauggccucggacuccaggugccccacgcagggcgaagcauaccuagacaagcagagugacacccaauacgucugcaagcgcacgcuaguagacagaggauggggaaacgguugcggccuauucggaaaagggucacucgugaccugcgcaaaguucgccugcaguaaaaagaugacaggcaaaagcauacaacccgagaaccuggaauaccguaucaugcucagcguacacggcucacaacauagcgggaugauagucaacgacacaggccacgaaacggacgagaacagagcaaaagucgaaauaaccccaaacucaccccgagcagaagcaacccuaggcggcuucggaucccugggacuagacugcgaacccagaacaggccuugacuuuuccgaucuguauuaccugacaaugaacaacaagcacuggcuaguacacaaagaaugguuccacgacauaccccuacccuggcacgcaggcgccgacaccggcacaccccacuggaacaacaaagaagcccucguagaguucaaagaagcccacgcaaagcgccaaacgguagucguacuggggagccaagagggagccguacacacagcgcuagcgggagcacucgaagcagaaauggacggggccaaagggagacuuagcagcggccaccuaaaaugccgacuaaaaauggacaaacuccgccuaaagggaguaucauacucccugugcacagcagcauucaccuucaccaagauccccgcagaaacacuccauggcacagucacaguagaaguacaguacgccggcaccgacggacccugcaaaguaccagcacaaauggccguagacaugcaaacacuaaccccaguaggcagacucaucacagcuaauccaguaauaacagaaagcaccgagaacaguaaaaugaugcuggagcucgacccgcccuucggcgacuccuacaucguaauaggagugggcgagaaaaagauaacacaccauuggcacagaagcggcagcaccauaggcaaagcauucgaagcgacggugcgcggggcuaaacgcauggcagugcuaggcgacaccgcgugggacuucggcucaguaggaggggcacuaaacucacucggaaaaggcauacaccagaucuucggagcagccuuuaagagccucuucggaggcaugagcugguucucgcaaauacucaucggcacacuucucauguggcucgggcuaaacaccaaaaacggaucaaucagccucaugugccuagcacuaggagggguccucaucuuccuaagcacggcggucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7357 - RNA, 2449 nt, Artificial Sequence
  KX447517.1 prME-short mRNA Design 2 opt
ggggcgcugccuacggagguggcagccaucuccuucucggcaucaagcuuaccaugaccagcguuggaauagucggccuacuacuaaccacagcaauggccgccgaagucacacgcagaggguccgcuuacuacauguaccuagaccgaaacgacgcgggcgaagcaaucagcuuccccaccacccucggaaugaacaaaugcuacauccaaaucauggaccuaggacacaugugcgacgcgacuaugaguuacgaaugccccaugcucgacgaaggagucgaaccggacgacguagacugcuggugcaacaccacguccaccuggguaguauacggaaccugccaccacaagaaaggcgaagcacgccgaagccgccgcgccgucacgcugccaucucacucaacacgaaaacuacaaacacgaagucagacauggcuagagagccgcgaguacaccaaacaccugauaagaguugaaaauuggauauucagaaacccaggcuucgcgcuggcggcagcagccaucgccuggcuccucggaucauccaccagccagaaagucauauaccuaguaaugauccuccucaucgcaccagcguacagcauccgcugcaucggcguaagcaaccgcgauuucguagaaggcaugagcggaggcaccuggguagacguaguacucgaacacggaggaugcguaaccgucauggcccaagacaaacccacagucgacaucgaacucgucaccaccacaguaagcaacauggccgagguccgcagcuacugcuacgaggcaagcaucagcgacauggcaucggacucccgaugcccaacccaaggggaagcguaccuagauaaacaaagcgacacacaauacgucugcaaacgcacacuuguagaccgaggaugggguaacggaugcggacucuuuggcaaaggcagccucgucacaugcgccaaauucgcaugcucaaagaaaaugacaggaaaauccauccagcccgagaaccuggaguaccgcaucaugcucaguguccacgggagccaacacucaggcaugaucgucaacgacacgggccacgaaaccgacgaaaaccgagccaaagucgaaaucacccccaacucgccaagagcagaagccgcccucggcggcuucggaucacucggacuggacugcgaacccagaacuggacucgacuucucagaccucuacuaccucaccaugaacaacaaacacuggcucguccacaaagaaugguuccacgacauaccccuacccuggcacgccggugcugacacaggcacuccacacuggaacaacaaagaagcccuaguagaguucaaagacgcacacgcaaaacgccaaaccguagucguacuagggagccaagaaggcgccguacacaccgcacuagcaggcgcacuagaagcagaaauggacggcgcaaaaggcagacugucuagcggccacuuaaaaugccgucucaaaauggacaaacugagacucaaaggaguaagcuacucccuaugcacagcagcauucacauucacaaaaauacccgcagaaacacuacacggcacaguaaccgucgagguacaauacgcagggacagacgggcccugcaaagucccagcacaaauggccguggauaugcaaacccucacacccguaggacgacuaauaaccgcaaacccagucauuacagaauccaccgaaaacagcaaaaugaugcucgaacuagacccaccauucggcgacucauacaucgucauaggagucggggaaaagaaaaucacacaccacuggcaccgcagcgggucgaccaucggcaaagccuucgaagcgacaguuagaggggcaaaaaggauggccguccuaggcgacaccgcgugggacuucggcuccguaggcggagcccuaaacagucucggcaaaggaauacaccaaaucuucggagcagcguucaaaucacuauuuggcggcaugucuugguucucacaaacccuaaucgggacccuccucauguggcucggccuaaacaccaaaaacggcuccaucagccucaugugcuuagcccucggcgggguccuaauauuccuuuccacagcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7358 - RNA, 2449 nt, Artificial Sequence
  KU926310.1 prME-short mRNA Design 2 opt
ggggcgcugccuacggagguggcagccaucuccuucucggcaucaagcuuaccaugaccagcguaggaaucgucggccuccuacuuaccaccgcaauggccgcagaagucacccgucgaggcucagccuacuacauguaccucgacagaaacgacgccggcgaagccaucagcuuuccgacaacgcuuggcaugaacaaaugcuacauacaaauaauggaccucggccacaugugcgacgcaacgaugucauaugaaugcccaaugcuagacgaaggcguagaaccagacgacgucgacugcugguguaacacaacauccaccuggguggucuacggaaccugccaccacaagaaaggagaagcucgacgaagccgacgcgccguaacacugcccagccauuccacgcgcaaacuccaaacacgcucccaaaccuggcuugagagccgagaguacacaaaacaccuaauacgcguggaaaacuggauauuccgaaaccccggcuucgcacucgccgcagccgcaauagcguggcuucuaggaagcuccaccucacagaaagugauauaucugguaaugauacugcucauagcacccgccuacagcauaagaugcaucggcgucucaaacagggacuucgucgaaggaaugagcggagggacgugggucgacgucguccuagaacacgggggcugcguaacagucauggcgcaagacaagcccacgguagacaucgaacuggucaccaccacagucucaaacauggccgaaguacgcuccuauugcuaugaagccucaaucucagacauggcguccgacagccgcugccccacccaaggcgaagccuaccucgacaaacaaucggacacccaauacgucugcaaaagaacacuuguagacaggggauggggcaacggaugcggacucuucggcaagggcagccuaguaacaugcgccaaauucgccugcucaaagaaaaugaccggaaaguccauccaacccgaaaaccuagaauacagaaucaugcuauccguacacggcagccaacacuccggcaugaucgucaacgacaccggccacgaaacagacgaaaaccgagccaaggucgaaauaacccccaacucacccagggcggaagcaacacuuggcggauucggcagccucggccuagacugcgaaccacgcaccggccuagacuucagcgaccucuacuaccuaacaaugaacaacaaacacuggcucguacauaaggagugguuccaugacauaccgcuacccuggcacgcaggcgccgacaccggaaccccacacuggaacaacaaagaagcgcucgucgaguucaaagacgcccacgccaaacgccagaccguagucguccuaggaucacaagaaggcgcuguacacacagcccucgccggagcccucgaagccgaaauggacggagcaaaaggccgccucagcagcgggcaccuaaaaugccgacuaaaaauggacaaacuccgucucaaaggaguaagcuacucccucugcacagccgcuuucaccuucacaaaaauaccagccgaaacccuccacggcaccgucacaguagaaguccaauacgcaggggcugacggacccugcaaaguccccgcccaaauggccguagacaugcaaacgcucaccccagucggcagacuuauaaccgcgaaccccguaaucaccgaaagcaccgaaaacucaaaaaugaugcucgagcuagacccacccuucggcgacagcuacaucgucaucggcgugggagaaaagaagaucacacaccacuggcacagaagcggcucgacaauaggcaaagcauucgaagccaccguacguggcgcgaaacgcauggccgugcucggagacaccgcuugggacuucgggagcguagggggagcccucaacucccucggcaagggaauacaccaaauauucggcgcugccuucaagagccucuucggcggaaugaguugguucucccaaauacucaucggaacucuccuaauguggcucggacucaacaccaaaaacggcucgauuucccucaugugccuugcacuuggcgguguccuuauauuucucuccaccgccguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7359 - RNA, 2449 nt, Artificial Sequence
  KU922923.1 prME-short mRNA Design 2 opt
ggggcgcugccuacggagguggcagccaucuccuucucggcaucaagcuuaccaugaccagcgucggcauuguaggccuauuacuuacaacagcuauggccgccgaagucacaagacggggauccgccuacuacauguaccuagaccgcaacgacgccggagaagccauaucauuccccacaacccuaggcaugaacaagugcuacauacaaauaauggaccuuggucacaugugcgacgccacaaugagcuacgaaugucccaugcucgacgaaggcguagagcccgacgacgucgacugcuggugcaacacaacauccacguggguaguauacgggaccugccaccacaagaaaggcgaggccagacggucacgacgagccguaacccuacccucccacuccacccgaaaacuccaaacacgcagccaaacuuggcuagaaucacgagaauacaccaaacaccuaauccgcguagagaacuggauauucagaaacccaggauucgcacuagccgccgccgcaauagccuggcuccuaggcucaucgaccucacagaaaguaaucuaccucguaaugauacuucucaucgcacucgccuacagcauccgcugcaucggcguaagcaaucgcgacuucgucgagggaaugucaggaggaacaugggucgacgucgugcuagagcacggcgggugcguaacggucauggcacaagacaaacccaccgucgacaucgaacucguaacgaccacagucucuaacauggccgaaguacgaaguuacugcuacgaagccuccauaucggacauggcaagcgacucccgcugcccgacccaaggagaagccuaccuggacaaacagagcgacacacaauacgugugcaaacgaacucuagucgaccgcggauggggcaacggaugcggccucuucggaaaaggaagccuaguaacaugcgcgaaauucgcuugcuccaagaaaaugaccgggaaauccauccaaccugagaaccuggaauaucgaauaaugcuauccguacacggcucccaacacuccggcaugaucgucaacgacacuggacaugaaacagacgaaaaccgcgccaaaguggaaaucacacccaacuccccacgcgcggaagcaacgcucggaggauucggcucacuaggccuagacugcgaacccagaaccggacuagacuucagcgaccucuacuaccucacaaugaacaacaaacacuggcuaguccacaaagaaugguuccacgacaucccccuaccauggcacgcaggggcggacacgggaacaccccacuggaacaacaaagaagcucucguagaguucaaagacgcgcaugcgaaacgacaaaccguaguaguccucggaucgcaagaaggagcaguacacaccgcccuggccggcgcccuagaagccgaaauggacggagcaaaaggccgacucagcagcgggcaccucaaaugcagacuaaaaauggacaaacuaagacucaaaggcguaagcuacagccuuugcacagcagccuuuacauucacaaaaauucccgcugaaacacuccacggcaccguaaccguagaaguccaauacgcaggcaccgacggaccaugcaaagucccagcacagauggcugucgacaugcaaacacucacacccguaggacgacuaauaacugccaaccccgugaucaccgaaagcacagaaaacagcaagaugaugcucgaacuggacccacccuucggcgacuccuauaucgucauuggagucggagaaaagaaaaucacccaccacuggcaccgcagcggcuccacaaucggcaaggccuucgaagcaaccguaagaggcgccaaaagaauggccguacuaggagacacggcaugggacuucggcagcguaggcggggcacucaacagucuaggaaagggcauccaccaaauauucggcgcagccuucaaaucacuauucggcggcaugagcugguucagucaaauacucauaggcacgcugcuaauguggcucggccucaauaccaaaaacggaucgaucucccucaugugccucgcccuuggaggcgugcuaaucuuccuauccaccgcagucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7360 - RNA, 2449 nt, Artificial Sequence
  KY075937.1 prME-short mRNA Design 2 opt
ggggcgcugccuacggagguggcagccaucuccuucucggcaucaagcuuaccaugaccuccguaggaauagucggccuccuccugaccacagccauggccgccgaagugaccagacgcggcucagcauacuacauguaccucgacaggaacgacgccggcgaagccaucucauucccgaccacauuaggcaugaacaaaugcuacauccaaaucauggaucuaggccacaugugcgaugccaccaugucauacgaaugccccaugcucgaugaaggcgucgaaccggacgacguagacugcuggugcaacaccaccuccaccugggucguauacggaaccugccaccacaagaaaggugaagcacgcagaagccgacgcgccgugacacuucccucacacuccacccgaaaacuacaaacacgcucacaaaccuggcuagaaucccgcgaauacaccaaacaccucauacgcgucgaaaacuggaucuuucgaaacccaggauucgcucucgccgcagccgcaaucgcauggcuucucggaucuuccacaucccaaaaagucaucuacuuaguuaugauccuccucaucgccccagccuacuccauacgaugcaucggcguaagcaaccgcgacuucgucgaaggcaugucgggaggcacguggguagacgucguucuagaacacgguggcugcguaacaguaauggcccaagacaagcccaccgucgacauugaacucgucaccaccacuguaucaaacauggcugaaguccgcagcuacugcuacgaagcaagcaucuccgacauggucuccgacagccgcugcccaacccaaggcgaagcguaccuagacaaacagucggacacccaauacgucugcaaacgcacccuagucgacagagguuggggcaacggaugcggacucuucggcaagggaucccuaguaacaugugccaaauucgcgugcucgaagaaaaugaccggaaaaagcauccagcccgaaaaccucgaauaccgcauaaugcucuccguccacggaagccaacacuccggcaugaucgugaacgacaccggacacgaaaccgacgaaaaccgcgcuaaaguagaaaucacaccaaacucaccccgcgcagaagcaacccuaggaggcuucggaucccucggccuagacugugaaccccggaccggccuagauuucuccgaccucuacuaccuaaccaugaacaacaaacacuggcucguacauaaagagugguuucacgacaucccccuccccuggcacgcgggcgcagacacagguacaccccauuggaacaacaaagaagcccuugucgaguucaaagacgcacacgccaaaagacaaaccgucgucgugcuuggcucccaggaaggagccgugcacacagcccuggccggagcgcuagaagcagaaauggacggcgccaaaggaagacuaagcuccggacaccuaaaaugccgacuaaaaauggacaaacuucgacuuaaaggagugucauacucacucugcacggccgcauuuaccuucaccaaaauccccgcagaaacacuacacggcaccgucaccgucgaaguacaauacgccggaaccgacggcccaugcaagguaccagcacaaauggccgucgacaugcagacacuuaccccgguaggccgacugauaaccgcuaacccagucaucaccgaaucaaccgaaaauucgaaaaugaugcuggaacucgacccacccuucggagacucauauaucgucauaggcguaggagaaaagaaaaucacccaccacuggcaccgcucuggcagcacaauaggaaaagccuucgaagccacagucagaggcgccaaacgcauggccgugcucggcgacaccgccugggacuucggaagcgucggaggcgcccucaacagccugggcaaaggaauccaccaaauauucggagcagccuuuaaaucccuuuucggaggaaugucaugguucucccaaauucuaauuggcacacuccuaauguggcucggacuaaacaccaaaaauggcucaauaagccugaugugucuagcacuaggaggcguacucaucuuccuuagcaccgccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7361 - RNA, 2449 nt, Artificial Sequence
  KY003156.1 prME-short mRNA Design 2 opt
ggggcgcugccuacggagguggcagccaucuccuucucggcaucaagcuuaccaugaccuccguaggcauagucggccuacuccugacaaccgcaauggcagccgaagucacacgccgcggaagcgccuacuacauguaccucgaccgaaaugacgccggcgaagccaucagcuuccccaccacgcucggcaugaacaaaugcuacauacaaaucauggaccucggccacaugugcgacgccaccaugucguacgaaugccccaugcuagacgaaggcgucgaaccagacgacguagacugcuggugcaacaccacaucgacauggguaguguacggaacaugccaccauaagaaaggagaagcaagacgcagcaggcgagcggucacccuacccagccacuccacgagaaaacuccagacacgcucccaaacauggcucgaaagcagagaauacacuaaacaccucauccgaguagaaaauuggauauuuagaaacccaggcuucgcgcuagcggcagccgcaaucgccuggcuacucgguaguuccacaucacaaaaaguaaucuaccucguaaugauccuccuaauugcaccagcauacuccauaagaugcaucggcaucuccaacagagacuucguggaaggcaugucagggggaacauggguagacguuguacucgagcacggcggcugcguaaccguaauggcccaagacaaaccaacaguggacaucgaacucguuaccacaaccgucaguaacauggccgaaguccguuccuacugcuacgaggccaguauauccgacauggccagcgacagccgcugcccaacccaaggggaagccuaccucgacaaacaaucagacacccaauauguuugcaaaagaacccuagucgaccgaggcuggggaaacggaugcggacuuuucggcaaaggcucgcucgucacaugcgccaaauucgcaugcuccaagaaaaugaccggcaaaagcauacaaccagaaaaccucgaauaccgcaucaugcucuccguacacgguagccaacacagcgggaugaucgucaacgacacaggccacgaaaccgacgaaaaccgcgcgaaagucgaaauaaccccuaacucaccccgugccgaagcaacacuuggcggguucgguauccugggccucgacugcgaacccagaaccggccucgacuucuccgaccucuacuaccuuaccaugaauaacaaacacuggcuaguccacaaagaaugguuccacgacauaccgcuccccuggcacgccggagccgacacaggcacaccccacuggaacaacaaagaagcccugguagaguucaaggacgcgcacgcaaaacgacagaccguagucgugcucggcagucaagaaggugcugugcacacggcacucgccggugcacuggaagcagaaauggacggagcaaaaggccgccuauccagcggccaucucaaaugccgacucaaaauggacaaacuacgucuaaaaggagugucguacagccuaugcacagccgccuucacauucacgaaaaucccagccgaaacacuacacggaacgguaacaguagaaguacaauaugcaggcaccgacggaccaugcaaaguacccgcccaaauggccguugacaugcaaacucuaacuccaguaggacgccugauuaccgccaacccagucaucaccgaaagcaccgaaaacucuaaaaugaugcucgaacuggacccaccauucggugacagcuacaucgucauaggcguaggagaaaagaaaaucacccaccacuggcaccgcagcggcuccaccauaggcaaagcauucgaagcaaccguccggggagccaaacgcauggcaguccucggcgacaccgccugggauuucggguccgucggcggggcccucaauucccuggggaaaggaauacaccaaaucuucggggccgccuucaaaagccuuuucggcggaaugucaugguucucucaaauacucaucggaacccuacuaauguggcuuggccugaacaccaaaaacggaagcaucucacucaugugccucgcacuuggaggcgugcucaucuuccuauccaccgcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7362 - RNA, 2449 nt, Artificial Sequence
  KU312313.1 prME-short mRNA Design 2 opt
ggggcgcugccuacggagguggcagccaucuccuucucggcaucaagcuuaccaugacaagcguaggcaucguaggacuccuccuaacaaccgccauggcagcagaaguuacacgccggggaucagcauacuacauguaccuagaccgcaacgacgccggugaagccaucucguuccccacaacacugggcaugaacaaaugcuacauccaaaucauggaccucggacauaccugcgacgcaacaaugucauaugaaugccccaugcuagacgaaggcgucgaacccgacgacguagacugcuggugcaacaccaccagcacguggguagucuauggcaccugucaccacaagaaaggcgaagcacgccguucucgcagagcagucacccuacccucacacagcauccgcaaacuucaaacccgcucccaaacauggcucgagucccgggaauauacgaaacaccucauacgaguagaaaacuggaucuuccgcaaccccggcuuugcccuagccgcagcagcaauagccuggcuauuaggcuccagcaccagccaaaaaguaaucuaccuggucaugauccuccucauugccccugcauacucaauacgcugcaucggagucucaaacagggauuucgucgagggaaugucgggcggaacgugggucgacgucguccucgaacacgguggcugcgugacagucauggcccaagacaaaccgacaguugacauagaacuugucaccacaacaguaucaaacauggcggaaguccgcagcuacugcuacgaagccucaauauccgacauggcaagcgacagccgaugcccaacccaaggcgaagcauaccucgacaaacaauccgacacgcaauauguaugcaaacgcacccuaguagaccggggcuggggaaacggcugcggacucuucggcaaaggcagccuagucacaugcgcuaaauucgccuguagcaagaaaaugacaggcaaaagcauccaacccgaaaaucucgaguaccgaaucaugcuaagcguacacggcucacaacacucaggaaugauagucaacgacacaggacacgagacagacgaaaaccgcgcaaaagucgagauaacgcccaacuccccacgcgcagaagcaacacucggcggcuucggaagucucggucuagacugcgaaccccgaacaggacuagacuucucagaccuauacuaccugacuaugaacaacaagcacuggcucguccacaaagaaugguuucacgacauccccuuaccauggcacgcaggcgcugacaccggcacaccacacuggaacaacaaagaagcacucgucgaguucaaagacgcucacgccaaacggcaaaccgucguuguccugggcucccaagaaggcgcgguacacaccgcccucgccggcgcucucgaggcagaaauggacggagcaaaaggacgccucuccaguggacaccucaaaugcagacuaaaaauggacaaacuacgccucaaaggugucucauacagccucuguacagcagcauucaccuucaccaaaaucccggccgagacacuccacggaaccguaaccguagaaguccaauacgcagggacagacggacccugcaaagucccagcacaaauggcaguagacaugcaaacacuaacacccgugggaagacucaucaccgcaaaccccgucaucaccgaaagcaccgaaaacagcaaaaugaugcuagaacuagacccacccuucggcgacucauacauaguaauaggcgugggagaaaagaaaaucacccaccacuggcaccgcagcggaucaaccauaggcaaagcauucgaagccacaguccgcggugcaaaacgcauggccguccucggcgacacagccugggacuucggcagcguaggcggcgcccuaaacucgcuaggaaaaggcauacaccagaucuucggggcagccuucaagagucucuucggcgguauguccugguucagccaaauccucaucgggacccuacucauguggcucggccucaacgccaaaaacggcucgaucucacucaugugccuagcacucggcggcguccucauauuccugucaacagccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7363 - RNA, 2449 nt, Artificial Sequence
  KY075935.1 prME-short mRNA Design 2 opt
ggggcgcugccuacggagguggcagccaucuccuucucggcaucaagcuuaccaugacaucagucgggauagucggccuacuacuaaccacggccauggcagccgaaguaacccgacgcggaucggcauacuacauguaccuagacagaaacgacgcaggagaagccauaucuuuccccaccacauuaggcaugaacaaaugcuacauccaaaucauggaccuaggacacaugugcgacgcaacgaugucguaugagugccccaugcucgacgaagggguggaacccgacgacguagacugcuggugcaacacaaccucaaccugggucguauacggaaccugccaucauaagaaaggggaagcccaacgcucccgcagagccguaacacuacccagccacagcaccagaaaacuacaaacccgcucacaaaccuggcuggaaucacgcgaguacaccaaacaccuaauaaggguagaaaacuggauauuccggaacccaggcuucgcccucgccgcagcagcaauagcauggcuacucggauccucaacaucccagaaagugaucuaccucguuaugauacuccuuaucgcccccgccuacagcauccgaugcauaggcgucagcaaccgagacuucguagaaggaaugagcggcggcaccuggguagacgucguacucgagcacggcgguugugucaccgucauggcccaggacaaaccaacaguagacauugaacucgugacaacaacggucuccaacauggcagaaguacgcagcuacugcuacgaagccagcaucagcgacauggccuccgacagccgcugccccacacaaggagaagcguaccuggacaaacaaucagacacccaauacgucugcaaacgcacccuagucgaccgaggauggggcaacggaugcggccucuucggcaaaggaucgcucguaacaugcgccaaauucgccugcagcaagaaaaugaccggaaaaucaauccaacccgaaaacuuagaauaccgcauaaugcuaucaguccacggcucacaacacagcggcaugaucguaaacgacaccggccacgaaaccgaugagaaccgcgcaaaggucgaaauaacccccaacagcccccgcgccgaagcaacccuaggaggauuuggaagccucggccuagacugcgaaccacgcaccggccucgacuucuccgaccuauacuaccucaccaugaacaacaagcacuggcugguccacaaagaaugguuccacgacaucccccuccccuggcacgccggagccgacacgggaacaccccacuggaauaacaaagaggcccuaguagaguucaaagacgcacacgcgaaacggcaaacaguaguuguacucggaucacaagaaggggccguacacacagcccuagcaggagcacucgaagcggaaauggacggagccaaaggcagacucagcagcgggcaucuaaaaugccgacucaaaauggacaaacuccgauugaaaggcgucagcuacagccucuguaccgcagcauuuacauucaccaagauacccgccgaaacacuacacggaacaguaaccguagaaguccaauacgccgggacagacgggcccugcaagguacccgcacagauggcaguggacaugcaaaccuuaacaccgguaggacgacugaucacagcgaacccagucaucacggaaucaaccgaaaacuccaaaaugaugcuggaacuagacccgccuuucggcgauagcuacaucguaauuggagugggcgaaaagaaaaucacacaccacuggcaccgcuccggcucaacaaucggaaaagccuucgaagccaccguccgcggcgccaaaagaauggcaguccuaggagacacagcaugggacuucgguagcguaggcggagccuuaaacucacugggaaaaggcauccaccaaaucuucggagccgcauucaaaucacuauucggaggaauguccugguucagucaaauacucaucggcacgcuacucauguggcuaggacucaacaccaaaaacggaagcaucucgcugaugugccuagcccuaggaggcguacucauauuccuauccacagcggucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7364 - RNA, 2449 nt, Artificial Sequence
  KY014320.1 prME-short mRNA Design 2 opt
ggggcgcugccuacggagguggcagccaucuccuucucggcaucaagcuuaccaugacaagcgucggaauagugggacuccuacucacaacagcaauggcggccgaggucacacgacgaggaagcgccuacuacauguaccuagaccgcaacgacgcaggagaggccaucucguuccccacgacccuaggcaugaacaaaugcuacauccagaucauggaccucggucacaugugcgacgcaacaaugucguacgaaugccccaugcucgacgaaggggucgaaccagacgacguagacugcuggugcaacacaacaagcaccugggugguauacggcaccugucaccacaagaaaggagaagcccgaagaagccgcagagccguaacacucccaagccacuccacccggaagcuacaggcacgcagccaaaccuggcuagaaagcagagaauacaccaaacaccucauacgcgucgaaaacuggauauucagaaaccccggauucgcccuagccgccgccgccaucgcguggcuuuuagguuccuccacuagccaaaaaguaauauaccuaguaaugauacuccuaauagcgccagccuacagcaucagaugcauaggcguauccaacagagacuucgucgaaggcauguccggaggaacaugggucgaugucguacuagaacacggcggcugcguaaccgucauggcccaagacaaaccaacaguagauauagaacucgucacuaccacgguaagcaacauggccgaggugcgcucauacugcuacgaggccagcaucucagacauggcaucagacucacgcugcccaacacaaggagaagcauacuuagacaaacaaagcgacacacaauacguaugcaaacgcacccuaguagauagaggcuggggcaacgggugcggacucuucggcaaaggaucccuagucacaugcgcgaaauucgccugcucaaagaaaaugacaggaaaaucaauacaaccagaaaaccucgaauaccgcaucaugcuaagcgugcacggaucacaacacuccggcaugaucguaaacgacacaggccacgaaacagacgaaaaccgagcaaaaguggaaauaacaccuaacucaccacgcgccgaagccacccuagggggcuucggcucacucggccucgacugcgaacccaggacaggccuggacuuuucggaccuguacuaccuuacaaugaacaacaaacacuggcuaguacauaaagaaugguuccacgacauuccacuucccuggcacgcaggagccgacaccggcaccccacacuggaacaauaaggaagcacucguagaguucaaagacgcccacgccaagagacagacaguagucguacucggaucccaggagggcgcaguacacacggcccuagcgggcgcacuagaagccgagauggacggcgccaaaggccggcucagcagcggccaccucaaaugccggcuuaaaauggacaagcucagacugaaaggcguaucauacagccuaugcaccgccgccuucacguucacaaaaaucccagcggaaacacuacacggaaccgucacagucgaagugcaauacgcgggcacagacggccccugcaaagugcccgcccaaauggcggucgacaugcaaacacuaaccccaguaggaagacucaucaccgcaaacccggucauaacagaaagcacagaaaacagcaagaugaugcuagaacuagacccaccauucggcgacucauacauagucaucggcguaggagaaaagaaaaucacacaccacuggcaccgaagcggcucuacaaucggaaaagccuucgaagccaccguacgcggcgcgaaacgcauggccguccucggagacacagcaugggacuuuggcagcguaggaggcgcccucaacucccuaggcaaaggcauccaccaaauauucggggccgccuucaaaucccucuucggaggaaugucaugguucagccagaucuuaauaggaacccugcuaauguggcuaggccucaacacgaaaaacggguccauaucgcuaaugugccuagcacugggcggaguccucauauuccuaucaacagccguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7365 - RNA, 2449 nt, Artificial Sequence
  KY328290.1 prME-short mRNA Design 2 opt
ggggcgcugccuacggagguggcagccaucuccuucucggcaucaagcuuaccaugacaagcgucggcaucguaggccuccuccugaccacagccauggcagccgaaguuacacgccgaggaucagcauacuacauguaccucgaccgcuccgacgcgggagaagccaucagcuucccuaccacccucggcaugaacaaaugcuacauacaaauaauggaccugggacacaugugcgacgcaacaaugucguacgaaugcccaaugcuagacgaaggcgucgaacccgaugacguagacugcuggugcaacaccacauccaccuggguggucuacggaaccugccaccacaaaaagggcgaggccagacggucgagacgcgcggucacccuuccuagccacagcaccagaaaacuacaaacacggucgcagacuuggcucgaaaguagagaguauaccaaacaccucauccgggucgaaaauuggaucuuccgcaaccccggauucgcgcucgccgccgccgcaauagcguggcuacucggcagcuccacaagccaaaaagucauauaccucguuaugauacuccucaucgcccccgccuacuccauucgaugcauaggcguaagcaacagagacuucguagaaggcaugaguggagggaccugggucgacguaguccucgaacacggcggcugcgucaccguaauggcgcaagacaaacccacaguagacaucgagcuagucaccaccaccguaaguaacauggcagaaguccgauccuacugcuacgaagcaucaaucuccgacauggccuccgauagccggugccccacacaaggcgaagcauaccucgacaagcaaagcgacacucaguacgucugcaaaagaacacucgucgaccgaggcuggggaaauggaugcggccuauucgguaaaggcucccucguaaccugcgccaaauucgcauguucgaagaaaaugaccggaaaaagcauacaacccgagaaccuagaauaccguauaaugcuaagcguccacggaagccaacacagcggaaugaucgucaacgacacaggccaugaaacagacgaaaaccgcgccaaaguagaaauaaccccuaacucaccaagggcagaagcaacccuaggcggauucggaagccuaggacucgacugugaaccaaggacaggacucgacuucucagaccuauacuaccucaccaugaacaacaaacacuggcugguccacaaagaaugguuccacgacauuccgcuaccguggcaugcuggcgccgauacaggcacgccccauuggaacaacaaagaagcacucguagaguucaaagacgcccacgcaaaacgccaaaccgucgugguccuagggagccaggaaggagccguccacaccgcccucgccggagcccucgaagccgaaauggacggcgcaaaaggccgcuuaagcuccggccaccuaaaaugccgccugaaaauggacaaacucaggcucaaaggcguaagcuacucgcuauguaccgcagcauucacauucagcaaaaucccagcagaaacacuacacggcacagucacagaagaaguacaguacgccggcaccgacggccccugcaaaguccccgcgcaaauggccgucgauaugcaaacacuaacacccguaggccgacuaauaacagcaaaccccguaaucaccgaaagcaccgaaaacagcaaaaugaugcuggaacucgacccgcccuucggagacucauacaucguaauaggcgucggagaaaagaaaaucacucaccacuggcaccgcuccggcagcaccaucggcaaagccuucgaagccaccguccgcggcgccaagcgaauggcgguacuaggcgacacagccugggacuucggaucaguuggaggagcccuaaacucacuaggcaagggcauacaccaaaucuucggagcagccuucaaaucccuauucgggggcaugagcugguucagccaaauccuaaucggaacccuccucauguggcucggccuaaacaccaaaaacggcuccauuagucuaaugugccuagcccucggcggcgugcucaucuuccuauccacagcgguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7366 - RNA, 2449 nt, Artificial Sequence
  KU681081.3 prME-short mRNA Design 2 opt
ggggcgcugccuacggagguggcagccaucuccuucucggcaucaagcuuaccaugaccucagucggaauaguaggacuacuccucacgacagcaauggccgcagaaguaaccagacgcgguuccgccuacuacauguaccucgaccgcuccgacgccggagaagccaucagcuuccccacaacccuaggcaugaacaaaugcuacauacaaaucauggaucucggacacaugugcgacgccaccauguccuacgaaugccccaugcucgacgaaggaguagagccggacgacguugacugcuggugcaacacaacauccacguggguagucuacggaaccugccaucacaagaaaggcgaagcccgaagaucccgccgcgccgucacacuacccagccacucaacgcggaaacuccaaacaagaucgcaaaccuggcuagaaagcagagaauauaccaaacaccuaaucagaguagagaacuggauauucaggaacccaggcuucgcacuagccgccgcagccauagccuggcuccucgguuccuccacaagccaaaaaguaauauaccucgucaugauacuccucaucgcaccagcauauucgauacguugcauaggagugagcaauagagacuucguagagggaaugucaggaggcaccuggguagacgucguacucgagcacggcggauguguaacaguuauggcccaagacaaacccaccgucgacauagaacucgucacaaccacagucucaaacauggccgaaguaagauccuacugcuacgaggcuuccaucucagacauggcauccgacucacgcugcccaacccaaggcgaagcguaucucgacaaacagucugacacccaguacgucugcaaacgcacacucguggacagaggauggggcaacggaugcggccucuucggcaaaggcucccuaguaacaugcgccaaauucgcaugcuccaagaaaaugaccggaaaaagcauacagcccgaaaaccucgaauaccgcauaaugcuaucaguccacggaucccaacacuccggcaugaucguaaacgacaccggccacgaaaccgacgaaaaccgcgcgaaagucgaaaucacccccaacagcccacgagccgaagccacacuagguggcuucggaagccucggacuggacugugaaccccgcacaggccuagacuucagcgaccuuuacuaccucaccaugaacaacaaacacuggcucguacacaaagaaugguuccacgacauaccacuaccguggcacacaggagcagacaccggaacaccacacuggaacaacaaagaagccuuaguagaguucaaagacgcccacgcaaaacgacaaacagucguaguacucggcucucaagaaggagccguccacaccgcacuagcaggcgcccucgaagccgaaauggacggagcuaaaggcaggcugagcucgggccaccuuaaaugcagacucaaaauggacaaacuuagacucaaaggaguaucauauucccucugcacagcagcauucaccuuuaccaaaauaccagccgaaacccuacacggaaccgugaccguagaaguucaauacgcaggaaccgacggcccaugcaaaguacccgcacaaauggcaguggacaugcagacccugacaccggucggacgccucauaacagccaaccccgucaucacugaaggcacagaaaacucgaaaaugaugcucgaacuagacccacccuucggcgacuccuacauagucaucggcgucggugaaaagaaaaucacacaccacuggcacagaagcggcucaacaaucggaaaagccuucgaagccaccguccgcggugcgaaaagaauggcaguccucggcgacacagcaugggauuucggaagcguaggcggaguacuaaacucgcucggcaaaggcauacaccaaaucuuuggcgcagccuucaaaagccuauucggaggcauguccugguucagccagauccuaaucggcacacuccuaauguggcugggacucaauaccaaaaacgggagcauaucccucaugugccuugcacuaggcggcguucucaucuuccucuccacagccgucagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7367 - RNA, 2449 nt, Artificial Sequence
  KX827309.1 prME-short mRNA Design 2 opt
ggggcgcugccuacggagguggcagccaucuccuucucggcaucaagcuuaccaugaccagcgucgguauagucggcuuacuccucacaacagcaauggcagccgaggucacccgaagaggaucagccuacuacauguaucuggaccgaucagacgcaggggaagcaaucuccuucccaacaacccuaggcaugaauaagugcuacauacaaauaauggaccucggacacaugugcgacgccacgauguccuacgaaugcccaaugcuugacgagggcguagaaccagacgacgucgacuguuggugcaacaccacguccacgugggucgucuacggaaccugccaccauaagaaaggcgaagcgcgacguagcagacgagcagucacucuaccaagccacagcaccagaaaacuacaaacaagaagccaaaccuggcuagaaagccgagaguacaccaaacaccuaauccgcguagaaaacuggaucuucaggaacccuggcuucgcacucgccgcagcagcaaucgccuggcugcucggaucaagcacaagccaaaaaguaauauaccuugugaugauccugcuaauagcccccgccuacuccauacgcugcauaggagucucaaaucgcgacuucguugaaggcauguccggcggcacaugggucgacguagugcucgaacacgguggcugcgucacagucauggcccaggacaaaccaacaguagacauagaacuuguaaccacuaccgucaguaacauggccgagguacguucauacuguuaugaagcauccauaucggacauggccucagacucccgaugcccaacccaaggcgaagcguaccucgacaaacaaucagacacacaauaugucugcaaacgcacccuagucgacagaggcuggggaaacggaugcggacucuucggaaaaggcucccucguaaccugcgcaaaauucgcgugcucaaagaaaaugacgggcaaaagcauacaacccgaaaaccucgaguaccgcaucaugcuaucaguccacgguucacagcauagcggcaugauaguaaacgacacaggacacgagacagacgagaaccgcgcaaaagucgagauuacaccuaauaguccccgcgcagaagccacauuaggcggauucggaagccugggacuagacugcgaaccucgaaccggacucgacuucuccgaccucuacuaccucaccaugaacaacaaacacuggcugguccacaaagaaugguuccacgacauccccuuaccauggcacgccggcgcggacacaggcaccccacacuggaacaacaaagaagcccuagucgaguucaaagacgcccacgccaaaagacaaacuguagucguccuaggaagccaagaaggagcagugcacaccgcacuggcaggcgcccuagaagcagaaauggacggcgccaaaggcagacugagcucaggccaccuaaaaugccgacucaaaauggauaaacuccgauuaaaaggggucucauacucccucugcaccgccgccuucacuuucacaaaaauccccgccgaaacccuccacgguaccgucaccgucgaaguacaauacgccggcaccgacggccccugcaaaguccccgcccaaauggccguagacaugcaaaccuuaaccccagucggacgccucaucacagcaaaucccgucaucaccgaauccaccgaaaacucgaaaaugaugcucgaacuagacccaccauucggagacagcuacaucgucaucggaguaggugaaaagaaaauaacccaccacuggcaccgcagcggaagcaccauaggaaaagccuucgaggccaccguccgaggagcaaaaagaauggcgguucucggugacaccgcaugggacuucggcagcguaggcggagcucugaacagccuaggaaaaggaauccaccaaauuuucggggccgcauucaaaagccucuucggaggaauguccugguucucgcaaauacucauuggcacacuccucauguggcucggacucaacacaaagaacggcagcaucagccucaugugccucgcccuugguggcguccucauauuccucagcacagccgucucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7368 - RNA, 2449 nt, Artificial Sequence
  KU955593.1 prME-short mRNA Design 2 opt
ggggcgcugccuacggagguggcagccaucuccuucucggcaucaagcuuaccaugaccagcgugggcauagucggacuccuacucaccaccgccauggccgucgaagucacgcgccggggcaacgccuacuacauguaccuagaccguagcgacgcaggagaggcaauaucauuccccacaacaaugggaaugaacaaaugcuacauccagaucauggaccuaggccacaugugcgacgcaacaaugucauacgaaugcccaaugcucgacgaaggaguggaacccgacgacguagacugcuggugcaacacaacaagcaccuggguaguauacggaacgugccaccacaagaaaggcgaagcccgacggucccggcgagccgucacccucccaagccacuccacacgaaaauuacaaacaaggagccaaaccuggcucgaaagccgagaguacaccaaacaccucaucagaguggaaaacuggaucuuccgaaacccuggauucgcgcucgccgcagcagccauagcauggcuucucggcuccaguaccagccagaaaguuaucuaccucguaaugauccuacucaucgcuccagcauacuccauccgaugcaucggcgucagcaaccgcgauuucgucgaagguaugagcggcggcacauggguagacgucguacuagaacacggcggcugugugacagucauggcucaggacaaaccaacagucgauaucgaacucguaaccacaaccgucuccaauauggcagaagucagaucauauugcuacgaagcaagcaucuccgacauggccagcgacucacguugcccaacccaaggcgaagccuaccuggacaaacaguccgacacccaauacguaugcaaacgaacccucguugaccgaggcuggggcaacggcugcggccucuucggcaaaggaucacucguaacaugcgccaaauucgcuugcucaaagaaaaugacgggaaaaagcauacaacccgaaaaccuagaguaccguauaaugcucuccguccauggaucccaacacucaggcaugaucgucaacgacacgggccacgaaacagacgaaaaccgcgcaaaagucgaaauaacacccaacagcccccgagccgaagcaacacucggaggcuucgguagccucggccuagacugugaaccgcgcacaggacuagacuuuagcgaccucuacuacuuaaccaugaacaacaaacacuggcucguccacaaagaaugguuccacgacauaccauugcccuggcacgcaggggccgacacaggcaccccacacuggaacaacaaagaagcccucguagaguucaaagaugcacacgcuaaaagacaaaccgucgucguacucggcagccaagaaggcgccguacacacagcccuugcgggcgcacuagaagcagaaauggacggagccaaaggccgacugucauccggccaccucaagugcagacucaaaauggacaaacuccgccuaaaaggcguuuccuacagccucugcaccgccgccuucacauucaccaagauucccgcggaaacucuccaugggaccgucacaguagaaguacaauacgcaggaacagacggccccugcaaaguccccgcccagauggccgucgacaugcaaacccugacccccgucgggcgucuaaucacagccaacccgguaaucaccgaaucgaccgaaaacucaaaaaugaugcuagaacuugacccgcccuucggcgacuccuacaucgucauaggcguaggcgaaaagaaaauaacccaucacuggcaccgauccgguagcaccauagggaaagccuucgaagccaccguacgcggagcaaaaagaauggccguccucggagacacagcaugggacuucggaucgguaggcggagcacucaauucacuaggcaaaggcauacaccagaucuucggcgcagcauucaaaagccucuucggcggaaugagcugguucagccaaauccuaauaggaacccuacugguuuggcuaggccucaacaccaaaaacggcucaaucagccucaugugccuugcccuaggaggcguccucauauuucuaucaacugcagucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7369 - RNA, 2449 nt, Artificial Sequence
  KY272987.1 prME-short mRNA Design 2 opt
ggggcgcugccuacggagguggcagccaucuccuucucggcaucaagcuuaccaugaccuccguaggcauagucggacuccucuugaccacagccauggcagccgaagucacccgacgcggcagcgcauacuacauguaccuagaccguuccgacgcaggcgaagcaauuagcuuccccaccacccuaggcaugaacaaaugcuacauacaaauaauggaucucgggcacaugugcgaugccacaaugucguacgaaugccccaugcucgacgaaggaguagaacccgacgacgucgacugcuggugcaacacaaccaguacauggguagucuacggaaccugccaccacaagaaaggugaagcucggagaucccgacgcgcggucacccuccccucccacuccacaagaaaacugcaaacaaggucacaaacauggcucgaaagcagagaauacaccaagcaccuaauaagaguggaaaacuggauauuucggaaccccggcuucgcguuagccgcagccgccaucgcguggcuccuagggagcucaacuucacaaaaaguaauauaccucgucaugauccuccugauagccccagccuacuccauacguugcauaggcguaucuaaccgcgacuucgucgaaggaauguccggaggcacaugggucgacgugguacucgaacauggcggcugcguaaccguaauggcacaagacaaaccgacgguagacauagaacugguuacaaccaccgucagcaacauggccgaaguaagaucauacuguuacgaagcaucaaucagcgacauggccagcgacucccgcugccccacccaaggagaagcguaucucgacaagcaauccgacacccaauauguaugcaaacgcacccucguggaccgaggauggggcaacggaugcggccuauucggcaaaggaucccuagucacaugcgcgaaguucgcaugcucaaagaaaaugaccggaaaauccauacaacccgagaaucucgaauacagaaucaugcucuccguacacgggucucaacauuccggcaugaucgugaacgacacuggccacgaaaccgaugaaaaccgagcaaaagucgagauaacaccaaauucaccccgcgccgaagccacccuaggaggcuucggaagccuaggccucgacugcgaaccccgaaccggacuggacuucuccgaccuguacuaccucacaaugaacaacaaacacuggcuaguccacaaagagugguuccacgacauaccacuucccuggcacgccggcgccgauacagggacaccccacuggaacaacaaagaagcccuuguagaguucaaagacgcacacgcaaaacgccaaacagucgugguccuaggcagccaagagggagccguacacaccgcccuagccggagcccuagaagccgaaauggacggcgccaaaggcagauuaagcuccggccaccucaagugccgacuaaaaauggauaaacugcgccuuaaaggcguaagcuacucccucuguacagcagcauucacauucacaaaaauacccgccgagacacuccacggaacaguaacagucgaaguccaauacgcaggaacagauggacccugcaaagucccggcacaaauggccguagacaugcaaacccuaacccccgucggcagacucauaaccgcaaaccccgucauaacagagucaaccgaaaacucaaaaaugaugcuggaacucgacccacccuucggcgacagcuacauaguaauaggcguaggcgaaaagaaaauaacacaccacuggcaccgcagcggaucaaccaucgggaaagccuucgaagccacgguccgaggcgcaaaaagaauggccgugcucggcgacacagccugggacuucggcagcgucggcggagcccucaacucccuaggcaagggcauucaccaaaucuucggagccgccuucaaaagccucuucggaggcaugucgugguucucccaaauacuaaucggcacccuccuuauguggcugggccucaacaccaaaaacggcuccaucucgcuagucugccuagcccucgggggaguccucauauuccuuucgacagcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7370 - RNA, 2449 nt, Artificial Sequence
  KY007221.1 prME-short mRNA Design 2 opt
ggggcgcugccuacggagguggcagccaucuccuucucggcaucaagcuuaccaugaccucaguuggaauaguggggcuacuacuaaccacagccauggcggcagaaguaacccgaagaggcagcgccuacuacauguaccucgaccgcagcgacgccggcgaagcaaucagcuucccaaccacccuaggaaugaacaaaugcuacauccaaaucauggaccuaggucacaugugcgacgccaccaugagcuacgaaugccccaugcuugacgaaggaguugaaccagacgacgucgacugcuggugcaacaccacaagcaccugggucgucuacgggaccugccaccacaagaaaggcgaagcgcgccgaagccgcagagcugucacccuccccagccacuccacccgaaaacuacaaaccaggagccaaacauggcucgaaagccgcgaauauaccaaacacuuaaucagaguggagaacuggauauuccgcaaccccggauucgcacucgcagcggcagcgaucgcauggcuccuaggcagcuccaccagccaaaaagucaucuacuuagucaugauccuccucauagcccccgccuacucgaucagaugcaucggcguuaacaaccgagacuucgucgaaggcaugucuggcggcaccuggguugacgucguccuagagcacggcggcugcguaaccguaauggcucaagacaaacccaccgucgacaucgagcuagucacaaccaccguaagcaacauggccgaaguucgaagcuacugcuacgaagcauccauuagcgacauggcaucagacucaaggugcccaacacaaggagaggcuuacuuagacaaacaaagcgacacgcaauacgugugcaaacgcacccuagucgaccgcggauggggcaacggcugcggccucuucgguaagggcagccugguaaccugcgcaaaauucgccugcucaaagaaaaugacaggaaaaagcauacagcccgaaaaucucgaauaccguauaaugcuaagcguccacggaucacaacacagcggaaugaucgucaacgacaccggacacgaaacagaugaaaaccgagccaaagucgaaaucaccccaaacagcccccgcgcugaagccacccugggcggguucggaucacuaggccuagacugcgagccgcgcacaggccuggacuucagcgaccucuacuaccuaaccaugaacaacaaacacuggcucguacacaaagaaugguuccacgacaucccacucccauggcacgccggcgcagacaccggaaccccgcacuggaacaacaaagaagcacucgucgaguucaaagacgcccacgccaaacgccagacagucgucguccugggaucccaagaaggcgccguccacacagcacucgccggcgcccuagaggccgaaauggacggagcaaaaggacgccuaucaaguggccaucucaaaugccggcuuaaaauggacaaacuuagauugaaaggcgucuccuacucucucuguaccgcggccuucacauucacaaaaauacccgcggaaacacuccacggcacagucaccgucgagguccaguacgcagggaccgaugggccgugcaaaguaccagcccaaauggccguagacaugcaaacacuaacccccgucggacgucuaauaacagccaaccccgucauaacggaaucaacagagaacuccaaaaugauguuagaauuagacccuccauucggcgacucguacaucgucauagggguaggagaaaagaaaaucacacaccacuggcaccgcagcggaagcaccauaggcaaagcguucgaagccaccguacgaggcgccaaacgcauggccguccucggagauaccgccugggacuucggaagcgucggcggagcccucaacucucuaggaaaaggcauccaccaaauauucggagccgcauucaaaagccuauucggaggcaugucaugguucucccaaauacucaucggaacgcucuuaauguggcuaggccucaauaccaaaaacggcuccauaucccuagucugcuuagcccucggcggcguccuaauauuccuaagcaccgcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7371 - RNA, 2449 nt, Artificial Sequence
  EU545988.1 prME-short mRNA Design 2 opt
ggggcgcugccuacggagguggcagccaucuccuucucggcaucaagcuuaccaugacaucaguagggaucgucggucugcuccugaccacagcaauggcaguggaagucacacgacgcggcagcgcguacuacauguaccucgaccgaucagacgcaggcgaagcaaucuccuuccccaccacacucggcaugaacaaaugcuacauccaaaucauggaccuaggacacaugugcgacgcaacaaugucauacgaaugcccaaugcuggacgaaggaguagaacccgacgacgucgacugcuggugcaacacuaccagcacaugggucguauacgggacuugccaucacaagaaaggggaagcaagacgcucacgacgagcggucacgcucccgagccacucaacacggaaacuccaaacucggucgcaaaccuggcuagaaucaagagaguacacaaaacaccuaauacgaguagaaaacuggaucuucagaaacccaggcuucgcccucgccgcggccgccaucgccuggcuccuaggcagcagcaccucccaaaaagucauauaccugguaaugauccuacugauagcaccagccuacucaaucaggugcauaggaguaagcaaccgagauuucguagaaggaauguccggaggcacauggguagacgugguccuggaacacggcggaugcgugacagucauggcccaagacaaaccagccgucgauauagaacucgucaccacaaccguaagcaacauggcagaaguaagauccuacugcuacgaagccagcauaagugacauggcaagcgacagccgcugccccacccaaggcgaagccuaccucgacaaacaaucagacacccaguacguaugcaaacgcacauuaguagacagaggcuggggcaacggcugcggacuauucgggaaaggcucgcugguaaccugcgccaaauucgcgugcuccaagaaaaugaccggcaaaagcauacagcccgaaaaccucgaauaccggauaauguuguccgugcacggcagccaacacuccggcaugaucgucaacgacaccggacaugagacagacgaaaaccgcgccaaaguagaaauaaccccuaacagcccgcgagccgaggcgacccucggagguuucggcucguuaggccucgauugcgaaccccguaccggacuagacuucuccgacuuauacuaccucacgaugaacaacaaacacuggcuuguacacaaagaaugguuccacgacauaccacugcccuggcacgccggcgcagacacaggcaccccacacuggaacaacaaagaggcccuaguagaauuuaaagacgcccaugcaaaacgccaaacaguaguaguccucggcagccaagaaggcgcagugcacacagcacuagccggagcccuagaggccgaaauggacggcgcaaaagggcgacuaaguagcggacaccuaaaaugccggcucaaaauggacaaacuccgccucaaaggcgucuccuacucccuaugcaccgcagcauuuacauucacaaaaauccccgcagaaacccuacauggaaccgugacaguagaaguccaauacgcaggaacggacgggccaugcaaagugcccgcacaaauggcaguagacaugcaaacacucacaccagucggcagacuaaucaccgcgaaucccgugauaaccgaaucaaccgaaaacagcaaaaugaugcuagaacuagacccacccuucggcgacaguuacauagucauaggcguaggagaaaagaaaaucacacaccacuggcaccgauccggaucaacaauaggaaaagcguucgaagcgaccguacgcggagccaaacgaauggcaguucucggagacacagccugggacuucggaagcguaggcggcgcgcuaaacagccucggcaaaggcauccaucagaucuucggagcagcguucaaaucacuauucggagggaugagcugguucagucagauacuaauaggcacauuguuaguguggcucggccuaaacacgaaaaacggcagcaucagcuuaaccugccucgcacucggcggcguacucauuuuucuaagcaccgcaguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7372 - RNA, 2449 nt, Artificial Sequence
  KU681082.3 prME-short mRNA Design 2 opt
ggggcgcugccuacggagguggcagccaucuccuucucggcaucaagcuuaccaugacaucagucggcaucguaggccuccuucuaacaaccgcaauggccguagagguaacgcgucgaggcucagcguacuacauguaccuggaccgaucagacgcgggggaggcgauaucguucccaaccacgcucggaaugaacaaaugcuacauacaaauaauggacuuaggacacaugugcgacgccaccauguccuacgaaugccccaugcucgacgaaggaguggaaccagacgacgucgacugcuggugcaacacaaccaguaccuggguagucuacggcacgugccaccacaagaaaggcgaagcccgccgcucccgccgagcugucacacucccaagccauagcacacgcaaacugcagaccagaagccaaaccuggcucgaaucuagagaauauacaaaacaccugauccgcguagagaacuggauauucagaaacccaggauucgcccuagccgcagcagucaucgccuggcuacucggauccagcacaucacagaagguaauauaccucguaaugauauuacucaucgcaccagcguauucgauccggugcaucggcguaagcaaccgagacuucguugaaggaaugucaggcgggaccugggucgacgucguccuggaacacggaggaugcguuacggucauggcacaagacaaacccacagucgacaucgaacucgucacaacgaccguaaguaacauggcagaaguacgguccuacugcuacgaagcuagcauaucagacauggcuucagacuccagaugccccacacagggcgaagccuaccuagacaaacaaucagacacgcaauacgucugcaaacgaacccucguagaccgaggcuggggaaacggcugcggccucuucggcaaaggaucgcucgugaccugcgccaaguuugcaugcuccaagaaaaugacaggcaaauccauacaacccgagaaccucgaauaccgcaucaugcucagcguccacggaucacaacacucgggaaugauagucaacgacaccgggcacgagaccgacgaaaaccgcgccaagguggaaauaacaccuaacagucccagagcagaagccacacucggcggauucgggucacucggccucgacugcgaaccacgaaccggacuagacuucagcgaccucuacuaccugacaaugaacaacaaacacuggcuuguacacaaagaaugguuccacgauauaccacucccauggcacgccggggccgauaccgguaccccacacuggaacaacaaagaggcacucguagaguucaaagacgcacacgcaaaacgccaaaccgucgucguacucgggucacaagaaggcgccgugcauacagcccucgcuggcgcccuagaagccgagauggacggcgcuaagggucgacuuuccucaggccaccuaaaaugccgccugaaaauggacaaacuccggcucaaaggggucuccuacucacucugcaccgcagccuucacuuucaccaagauacccgccgaaacccuccacggcaccgucaccgucgaaguccaauacgcaggaaccgacggacccugcaaaguacccgcucaaauggcgguagacaugcaaacccugacgcccgucggccgccuaauuaccgccaauccugucauaaccgaaucgacagaaaacagcaaaaugaugcucgaacuggacccacccuucggcgacagcuacauagucaucggcgucggcgaaaagaaaaucacccaccacuggcaccgauccgguagcaccauaggaaaagcauucgaagccaccguacggggagcaaaaagaauggcgguacugggcgacaccgcaugggacuucgggagugucggaggagcccuuaacucguuaggcaaaggcauacaccagauauucggcgccgccuucaaaagccuguucggcggcaugagcugguucagccaaauccuaaucgggacacuccuggucuggcuaggccucaacaccaagaacggauccauuagccuaaccugccuggcacucggaggaguucuaauauuccucagcaccgccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7373 - RNA, 2449 nt, Artificial Sequence
  KX601167.1 prME-short mRNA Design 2 opt
ggggcgcugccuacggagguggcagccaucuccuucucggcaucaagcuuaccaugacgagcguaggcauaguaggccuccuacuaaccaccgcaauggccguagagguaacccgccgaggcucagccuacuacauguaccuagaccgaagcgacgccggcgaagccaucagcuuucccacgacccuaggagucaacaaaugcuacauacaaauaauggaccucgggcacaugugcgacgcaaccaugucauacgagugcccaaugcuagacgaaggagucgaacccgaugacgucgauugcugguguaacaccaccucaacgugggucgucuacggaacaugccaccacaagaaaggcgaagcacggcggagcagacgagcagucacgcuaccaucccacucaacacgcaaacuccaaacccgaucacaaacauggcucgaaucccgcgaauacaccaaacaccuaaucagaguagaaaacuggaucuuucgcaaccccgguuucgcacucgcagcagccgcuaucgcauggcuacuaggcucauccaccucacagaaagucauuuaccucgugaugauccuacuaaucgcacccgcauacucgauccgcugcauaggaguuagcaaccgcgacuucguagaaggaaugagcggcggcacauggguagacguagugcuagaacacggcggcugcgucaccgucauggcccaggacaaacccacgguagacaucgaauuagucacuacaacggucagcaacauggcagaaguccgcucauacugcuacgaggcaagcaucuccgacauggcuuccgacagccgcugucccacgcagggcgaagccuaccuagacaaacaauccgacacacaauacgucugcaaaaggacccuaguagacagaggauggggaaacgggugcggacucuucggaaaaggcagccucgugaccugcgccaaauucgccugcucaaagaaaaugaccggaaaaagcauccaacccgaaaaucucgaguacagaaucaugcucagcguccacggaucacaacacagcggcaugauagucaacgacacggggcacgaaacggaugaaaaccgcgccaaagucgaaaucacccccaacagcccccgagccgaagccacccucggcggguucggaucgcuaggacucgacugcgaaccacgaacaggccuggacuucagcgaccucuacuaccuaacgaugaacaauaaacacuggcuaguacacaaagaaugguuucacgacaucccacuccccuggcacgccggagccgacaccggaacaccccacuggaacaacaaagaagcacugguugaguucaaggacgcacacgcaaaacgccagaccgugguugugcuaggcucacaagaaggcgcaguacacaccgcccuggcaggagcucuagaagccgagauggacggagccaaagggcgccucagcuccggacaccucaaaugccgccuaaaaauggacaaacuccgacuaaaaggagucucuuacucacucugcaccgccgcauucaccuucaccaaaauacccgcagagacccuccacggcacagugaccgucgaaguacaauacgccggaacagacggcccaugcaaaguaccggcccaaauggccguagacaugcaaacacucaccccagucggcagacuaaucacagcaaaccccgucauaacagaauccacagagaacagcaaaaugaugcucgaacuagauccgcccuucggcgauagcuacauaguaaucggugucggagacaagaagaucacccaccacugguaccgauccgguagcaccaucggcaaagcauucgaagccaccguccgaggcgccaaaagaauggcaguccucggcgacaccgcgugggacuucggcagcguaggaggagcccucaacucccucggaaaaggcauccaccaaaucuucggcgccgccuucaaaagccuauucgguggaaugagcugguucucccagauccugauuggcacgcuucuaguauggcuaggccuaaacacgaagaacggcagcauaucccucacgugccuugcgcuaggcggcguacuaauauucuuaagcaccgccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7374 - RNA, 2449 nt, Artificial Sequence
  KX694533.2 prME-short mRNA Design 2 opt
ggggcgcugccuacggagguggcagccaucuccuucucggcaucaagcuuaccaugaccagcgucggcaucgugggccuccuccuaacuaccgccauggccgucgaagucacacgccgcggcagcgcguauuacauguaccuggacagaagcgaugccggaaaagccauaucauuccccaccacccuaggaguuaauaaaugcuacauacaaaucauggaccucggccacaugugcgacgcaaccauguccuacgaaugcccaaugcuagacgaaggcguagaaccugacgacguggacugcuggugcaacaccacaucaaccugggucguuuacggcacaugccaccacaagaaaggggaagcccgacgcuccaggcgcgcggucacccucccaucacacucaacccgcaaacuacaaacacgaucccagacuuggcuagaaucgcgcgaauacaccaaacaccucaucagagucgagaacuggaucuuccgaaaccccggcuucgcacuagcagccgcugccauagcaugguuauuaggcucgagcaccucacagaaagugauauaucucgucaugauacugcucaucgcgccagcguacuccauucggugcauaggcguaagcaacagagacuucgucgaaggcauguccggcggaaccuggguagacgucguccucgaacacgguggcugcgugaccguaauggcccaagacaaacccacaguagacaucgaacugguuaccacaaccguauccaacauggccgaagugcgcucauauugcuaugaagccagcaucucagacauggcaucggacucccgcugcccaacacaaggagaagcguaccucgacaaacaaagcgacacccaguacgucugcaaaaggacacucgucgacagaggcuggggcaacggaugcggccucuucggcaaaggcagccucguaaccugcgccaaauuugccuguagcaagaaaaugaccggcaaaagcauacaacccgaaaaccucgaauaccggauuaugcucagcguccacggcucacaacacagcggcaugaucgucaaugacauaggccacgagaccgacgaaaaccgcgccaaagucgagaucacccccaacuccccacgcgcagaggcaacucucgggggauucggcucccucggcuuagacugcgaaccccgaaccggacucgacuucucagaccuguacuaccucaccaugaauaacaaacacuggcuaguccacaaagaaugguuccacgacauaccccuccccuggcacgcaggcgcggacaccggaacaccgcacuggaacaacaaagaggcccucgucgaguucaaagacgcacacgccaaacgucaaacaguagucguacucggcucccaagaaggcgccguacauaccgcacucgccggcgcccuagaagcagaaauggacggcgccaaaggacgucuaagcuccggccaccucaaaugcagacugaaaauggauaaacuacgccucaaaggcgucagcuacucccucugcacagccgcuuucacauuuaccaaaaucccagccgaaacauuacacggaacuguuaccguagaaguccaguacgccggcaccgacggcccaugcaaagucccagcccaaauggcagucgauaugcaaacacuuacaccagucggacgccucaucacagcaaacccgguaauaaccgaaucaaccgaaaacuccaaaaugaugcuagagcucgaucccccuuuuggcgacagcuacaucgucaucggagucggggacaagaaaaucacccaccacuggcaccgcucaggcuccaccaucgggaaagcauucgaagccacaguacguggugccaaacgcauggccguacucggcgacacagcgugggacuucggcagcgucggaggcgcacucaacucacucgggaaaggcauccaccaaaucuucggcgccgcauucaaaucccuauucggcggcaugucaugguucucccaaauacuaaucggcacccuacucgucuggcuaggacucaacaccaaaaacggaagcaucagccucacgugccuagcccucggaggcguccucauauuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7375 - RNA, 2449 nt, Artificial Sequence
  KY288905.1 prME-short mRNA Design 2 opt
ggggcgcugccuacggagguggcagccaucuccuucucggcaucaagcuuaccaugacaagcaucggcaucgucgggcuccuacucaccaccgcaauggccgcagaaaucacccgaagaggaagcgccuacuacauguaccuggaccggagcgacgcaggaaaagccauuagcuucgccaccacacuaggaguaaacaaaugucacgugcagaucauggaccuaggccacaugugugacgcgacaauguccuacgaaugcccaaugcuggaugaaggaguagaacccgacgacguggacugcuggugcaacacaacuagcacaugggucgucuacggcacaugccaccacaagaaaggagaggcccgaagaucccggcgcgcagucacccuaccgucccacaguacccgcaaacuccaaaccagaagccaaacauggcuagaaagcagagaauacacgaaacaccucaucaaaguugaaaacuggaucuuccgaaaccccggauucacgcugguagcagucgcaaucgcauggcuccuagggucuagcacuucacaaaaaguaauauaccucgucaugauccuucugauagcgccggccuacagcauacgcugcaucggaguauccaauagagacuucguagaggggauguccggcggcacaugggucgacguaguccucgaacauggaggcugugucaccguaauggcccaggacaagccaaccguagacaucgagcucguaacaaccaccguauccaacauggcggaaguaagaagcuacugcuacgaagccagcaucagcgacauggccuccgacucgcggugcccaacccaaggcgaagccuaucucgacaagcaauccgacacacaguacguaugcaaaagaacccucgucgaucgcggcuggggcaacgggugcggccucuucggaaaaggcagccucguaaccugcgcaaaauuuaccugcuccaaaaagaugaccggaaaaucaauccagccagaaaaccucgaauaccgcaucaugcucagcguccacggaagccaacauagcggcaugaucguaaacgacacaggacacgaaaccgacgaaaaccgcgcaaagguagaaguaacccccaacagcccacgcgcggaagcgacgcuaggaggcuucggaagccugggacucgacugcgaaccccgcacgggccuggacuucucagaccucuacuaccucacaaugaacaacaagcacuggcuaguccacaaagaaugguuccacgacaucccacucccguggcacgcgggcgcagacaccggaacaccccacuggaacaacaaagaggcccuaguggaguucaaagacgcacacgccaaacgacaaaccguagucguccuaggcagccaagaaggcgccguccacaccgcccucgcaggcgcccuagaagccgaaauggacggagcaaaaggacgacuauucucgggacaccucaaaugcagacucaaaauggacaaacuuagacuaaaaggggucucauacagccucuguacagcagcauucaccuucacgaaaguaccggccgaaacacuacacggaaccguaacaguagagguacaauacgcagggacggacggcccgugcaaagucccagcccaaauggcuguagacaugcaaacccuaacaccagucggccgccucauaaccgcaaacccaguuaucacagaaucaacagaaaacucaaaaaugaugcuagaacuagacccacccuucggagacagcuacauagucauaggaguuggagacaagaaaauaacacaccacuggcaccggucagggagcacaaucggaaaagccuucgaagcaaccguaagaggcgcaaaaagaauggcgguccuuggcgacaccgcaugggacuucggaucaguuggaggcguguucaacucacucgggaaaggcauacaccaaauauucggagcggcauucaaaucacuauucgggggaauguccugguucagucaaauacucauaggcacccugcuaguauggcuugggcuaaacacaaagaacggauccauaagccuaaccugccucgcacugggaggcgucaugaucuuccuaucaaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7376 - RNA, 2449 nt, Artificial Sequence
  KF268950.1 prME-short mRNA Design 2 opt
ggggcgcugccuacggagguggcagccaucuccuucucggcaucaagcuuaccaugacaucaauagggaucauaggccuccuccugacaaccgcaauggcggcugagauaacgcgccgagggagcgccuacuacauguaccuagacagaucggacgcagggaaagcaaucagcuucgccaccaacuugggagucaacaaaugccacguccaaaucauggaccucggacacaugugcgacgccacaaugucuuacgagugccccaugcuagacgaagggguagaacccgacgacguggacuguuggugcaacaccacaagcaccuggguagucuacggaaccugccaccacaagaaaggcgaagcccggagaucccgccgagccguaacccuccccucccacucgacccgaaaacuccagacaagaagucaaaccuggcuugaauccagagaauacacgaaacaccuaauaaaaguugaaaacuggaucuuccgcaaccccggcuucgcccucgccgcggucgccauagccuggcuccuaggcagcucgaccagucaaaaaguaaucuaccuagucaugauccuacucaucgccccggcauacagcauacgauguaucggagugagcaaccgagacuucgucgaaggaaugagcggcggaacuuggguagacguugucuuagagcacggcggcugcguaaccgucauggcccaggacaaaccaaccgucgacaucgagcuagugaccaccacggucucaaacauggccgaagugagaucguacugcuacgaagccuccauauccgacauggcaucagacucgagaugcccaacacaaggcgaagccuaccucgacaaacaaagcgacacacaauacgugugcaaacgcacccuaguagacagaggauggggcaacggaugcggacucuucggaaaaggcagccuagucacuugcgcgaaauucacaugcagcaagaaaaugaccggcaaaagcauacaaccggaaaaccuagaauaccgcaucaugcucagcguacacgguucacaacacuccggcaugaucgucaacgacauaggacacgaaaccgacgaaaaccgcgcaaaaguggaagucaccccaaacucaccgagagcagaagcaacacucggcggauucggaucacuaggucucgacugcgaaccgcgcacuggccuagacuucuccgaccucuacuaccuuacaaugaacaacaagcacuggcuaguccacaaagaaugguuccaugacauuccguugccauggcacgcaggagccgacacaggaacaccacacuggaacaacaaagaagcgcuaguagaguucaaagacgcccacgccaagcgucaaaccgugguaguccuaggaagccaagaaggcgccgugcacacagcacuagccggagcacucgaagccgaaauggacggugccaaagggcgacuauucagcggccaccucaaaugcaggcucaaaauggacaaacugcgacuaaaaggaguaucguacucacuaugcaccgccgccuucacauucacaaaaguaccggccgaaacccuacacggcacaguaaccguggaaguccaguacgcaggaaccgacggaccuugcaaaguccccgcccaaauggccgucgacaugcaaacacucacacccgucggcagacugauaaccgcaaacccaguaaucaccgaaagcacugagaacagcaaaaugauguuagaacuagaucccccauucggcgacucauacaucgucaucggagucggcgacaagaaaauaacccaccacuggcaccgcaguggcucaaccaucggcaaagcauucgaagccaccguacgcggcgccaaacgcauggcaguccucggugacacagcaugggauuucggaagcgucggcggcgucuucaacucccucggcaaaggugugcaccaaaucuucggcgccgccuucaagagccucuucggaggcaugucgugguucucacaaauccuuaucgggacacuccuagucuggcuaggacuaaacaccaagaacggcaguaucagccuaaccugccucgcccuaggcgggguaaugauauuccuaagcacggccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7377 - RNA, 2449 nt, Artificial Sequence
  KF383121.1 prME-short mRNA Design 2 opt
ggggcgcugccuacggagguggcagccaucuccuucucggcaucaagcuuaccaugaccuccaucgggaucauaggccuauuacuaaccaccgcaauggcagccgagaucacccggcgcgguagcgccuacuacauguaccucgauagaucagaugcaggcaaagcaauauccuucgcaaccacacucggaguaaacaagugccacguccaaaucauggaccuaggccacaugugcgacgcaacaaugucauacgaaugcccaaugcuagacgagggcgucgaacccgacgacguagacugcuggugcaacaccacaagcacauggguagucuacggaacaugucaccacaagaaaggagaggccaggagaagccgacgcgcagucacccucccaagccacucgacacgaaaacuccaaacacgcagccaaacauggcuggaaagccgcgaauacaccaaacaccucaucaaaguagaaaacuggaucuuccgcaacccaggcuucgcacucguagccguagccauagccuggcuccugggaagcagcaccagccaaaaagucauauaccucguaaugauccuccugaucgcaccagccuacucgaucaggugcauuggcgucagcaaccgagacuucgucgaaggcauguccggaggcacauggguagacgucgugcuagagcacggcggcugcgucacggucauggcccaagacaaacccacgguggacauugaacucguaaccaccacagucagcaacauggcugaagucagaagcuacugcuacgaggcaucgaucagcgacauggccagugacucaagaugcccaacacaaggggaagcauaccucgacaaacagucagacacccaauacgucugcaagcgaacacucguagaccgcggcuggggcaacggcugcggacucuucggcaagggcucucuggucacaugcgccaaauucacguguagcaagaaaaugacuggcaaaucaauccaaccagaaaaucucgaauaccgaaucaugcuauccguacacggcucacaacacagcggcaugauaguaaaugacauaggucaugaaacugacgaaaacagagcaaaagucgagguaacccccaacagcccgcgcgcugaagcaacgcucggcggcuucgggagccuaggacucgacugcgaaccccgaacgggccuagacuuuagcgaucuguacuaccucacaaugaacaacaaacacuggcucgugcacaaagagugguuccacgacaucccccuccccuggcacgccggagccgacaccggcacaccccauuggaacaacaaagaagcccucguggaguucaaggacgcacacgcaaaacggcaaaccguagucguccuaggaucacaggaaggcgccguccacaccgccuuagcgggagcacucgaagcagaaauggacggcgccaaagggcgccuauucuccggacaccugaagugucgucucaaaauggacaaacuccgacuaaaaggaguguccuacagccucugcaccgcagcauucacauucaccaaaguccccgccgaaacccuccacgggacaguaacagucgaaguccaauacgccgguacagacggaccaugcaaaguccccgcccaaauggcaguagacaugcaaacacuaacccccgucgggcgacucaucaccgccaaccccguuauaacagaaagcacggaaaacagcaaaaugaugcuggaacuugacccucccuucggggacucauacauaguaauaggcgucggagacaagaaaaucacacaccauuggcaccgaagcggauccacaauaggaaaagcauucgaagccaccguacgaggggcaaaacggauggcaguacuaggcgacaccgccugggacuuuggcucaguaggcggcgucuucaacagccucgggaaaggcauccaccaaauauucggugccgccuucaaaucacucuucggcggaaugagcugguucagccaaauccugauuggaacccuacucgucuggcugggcuuaaacaccaaaaacggcagcaucucccugacaugucucgcccuagggggaguaaugauauuccuaucaaccgccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7378 - RNA, 2431 nt, Artificial Sequence
  KF268949.1 prME-short mRNA Design 2 opt
ggggcgcugccuacggagguggcagccaucuccuucucggcaucaagcuuaccaugacaagcauagguaucauagggcuucuacucacaaccgccauggcagccgaaaucacccgacggggcuccgccuacuacauguacuuagacagaagcgacgcaggaaaagccaucucauucgccaccaaccuaggagucaacaagugccacguacaaauaauggaccugggacacaugugcgacgccacuauguccuacgaaugccccaugcucgacgagggcgucgaaccagacgacguugacugcuggugcaacaccacaagcacaugggucgucuacgggaccugccaccacaagaaaggcgaagcacgccggagccggcgcgccgucacgcuuccgagccacagcacccgcaaacuacaaacaagaucacagacguggcucgagagcagagaauacaccaagcaccucaucaaaguagaaaacuggauuuuccgcaaccccggauucgcucuagccgcagucgcaaucgccuggcuccuaggcucgagcacaagccaaaaagucaucuaccuaguaaugauccuccuaaucgcacccgcauacucaauacgcugcauaggcgucagcaaccgcgacuuuguagaaggaaugucaggagggacauggguagacguaguccucgaacacggaggcugcgucaccgucauggcacaggacaaacccaccguagacauagagcucguaaccacaacaguaagcaauauggcggaaguccguuccuacuguuacgaggcuucaaucucagacauggcgucagacucacgaugucccacccaaggcgaagcauaccuggacaaacaaucagacacccaauacguauguaaaaggacccucguugaccgcggcugggggaacggaugcgggcuauucggaaaaggaucccucgucaccugugccaaauucacaugcucaaagaaaaugaccggaaaaucaauccagccggaaaaccuagaauacaggauaaugcucucaguccacggaagccaacacagcggaaugauagucaacgacgaaaacagggccaaagucgagguuacacccaacagcccacgcgccgaagcaacacuaggaggauucgggagccuaggucuugacugcgaaccgcgaaccggccuggacuucucagaccucuacuaccuaaccaugaacaacaaacacuggcucguacacaaagaaugguuccacgacaucccgcucccguggcacgccggagcagacacaggcaccccacacuggaacaacaaagaggcccucguagaguucaaagacgcccacgcgaaacgccaaacaguaguaguacuggguucccaagaaggcgcaguccacaccgcgcuagcaggcgcacuagaagccgaaauggacggagccaaaggacgucuauucuccggacaccucaaaugccggcuaaaaauggacaaacuaagacucaaaggaguaucguacucccucugcacagccgccuuuacauucacgaaggucccagccgaaacccuacacggaaccgugaccgucgaaguacaauaugcgggaaccgacggcccaugcaagguaccagcccaaauggcagucgacaugcaaacccucacgcccgucggacgccucaucacagcaaauccaguaaucacagaaagcaccgaaaauucaaaaaugaugcuggaacuagacccacccuucggagacagcuacaucguaaucggcgucggagacaagaaaaucacacaucacuggcauaggagcgggagcacaauuggaaaagccuucgaagcaaccguaagaggcgccaaacgaauggcgguccuaggugacacagccugggacuucggcagcgucgggggcgucuucaacagccuaggcaaaggcauccaccaaauauucggagcagccuuuaaaagccuauucgguggcaugucaugguucagccagauccucauaggaacccugcuagucuggcuaggacuaaacacgaaaaacgggagcauaagccugacaugccucgcucugggaggcgucaugauauucuuaagcacggccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7379 - RNA, 2449 nt, Artificial Sequence
  KU955595.1 prME-short mRNA Design 2 opt
ggggcgcugccuacggagguggcagccaucuccuucucggcaucaagcuuaccaugaccagcauaggaauaguaggccuccuacucacaaccgccauggcggcggagaucaccagacgaggcagcgcauacuacauguaccucgacaggucagacgccgggaaagcaaucagcuucgcaaccacacugggagucaacaaaugccacguacagauaauggaccugggacacaugugugacgcaaccaugucauacgagugccccaugcuagaugaaggaguagagcccgacgacguagacugcuggugcaauacaaccagcacaugggucguguacggaaccugccaccacaagaaaggcgaagcuagaagaagccgcagagcgguaacccuaccaagccacagcacgcgaaaacuccaaacccgaagccaaaccuggcuugagagccgggaauacacgaaacaccuaaucaagguagaaaacuggauauuccgcaaucccgguuucgcgcucgucgcagucgcaauagcauggcuccuaggaagcagcacaagccagaaagugauauaccuaguaaugauccuacugauagccccagcguacagcauccgcugcaucggcguaagcaaccgcgacuucguagaaggaauguccggaggcacauggguagacguaguccucgagcacggcggcuguguaacaguaauggcacaagacaaaccaacggucgacauagagcuagucaccacaacaguaagcaacauggcagaagugcgaagcuacugcuacgaagcauccaucucagacauggccagcgacagucgaugccccacacaaggcgaagcauaccuagacaaacaauccgacacccaauacgucugcaaaagaacgcuagucgauagagguuggggcaacggcugcggauuauucggcaaaggcucgcuagugacaugcgcgaaauucacaugcagcaagaaaaugacgggcaaaagcauccagcccgaaaaccucgaguacagaauaaugcuauccguccacggcagccaacacagcggcaugauagucaacgacacugggcacgaaacagacgaaaacagggccaaaguagaagucaccccaaacagcccacgcgcggaagcgacccucggaggguucgggucacucggacuagacugcgaaccacgaacagggcucgacuucuccgaccucuacuaccuaacgaugaacaacaaacacuggcugguacacaaagagugguuccacgacauacccuugccauggcacgcaggggcggacacaggaaccccacacuggaacaauaaagaggcgcuagucgaguucaaagacgcacacgcaaaacgacaaacaguaguaguacuaggaagccaagaaggcgcaguacacacagcacuagccggcgcgcuggaagccgaaauggacggcgcaaaaggacgacuauucagcggccaccugaaaugcaggcucaaaauggacaaacugagacugaaaggagucuccuacucacuaugcacagcagcauuuaccuucacgaaaguaccagccgaaacccuacacggaacaguaacgguagaaguccaguacgcaggaacagacgggccaugcaaaguaccagcacagauggccgucgacaugcagacccucacaccagucgggcgccuaauuacagccaacccgguaaucacagaaagcaccgaaaacuccaagaugaugcuagaacuagacccacccuucggcgacagcuacaucgugaucgguguaggugacaagaaaaucacacaccacuggcaccggagcggcagcacaauagggaaagccuucgaagcgacaguacgcggcgcgaaacgcauggccguacucggcgacaccgcaugggacuucggaagcgugggcggcgucuucaacagccucggaaaagguauccaccaaaucuucggggcagccuucaaaagccucuucgggggaaugagcugguucucacaaauacuuauagggacacugcuaguauggcucggccucaacaccaaaaacggaagcauaagccuaaccugccuagcacugggaggcgugaugauauucuuaagcacagccgucucggcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7380 - RNA, 2449 nt, Artificial Sequence
  KF383116.1 prME-short mRNA Design 2 opt
ggggcgcugccuacggagguggcagccaucuccuucucggcaucaagcuuaccaugacgagcauaggaaucgucggacuacuacuaaccaccgcaauggccgcagaaaucacacgcagaggaagcgcauacuacauguaccuagauaggagcgaugccggcaaagccaucagcuucgcgacaacacuaggugucaacaaaugccacguacaaauaauggaccuaggccauaugugcgacgccaccaugucauacgaaugccccaugcuagacgaaggcgucgaaccagacgacguggacugcugguguaauaccacauccaccuggguagucuacggcacaugccagcacaagaaaggagaggcacgacgcucaagacgagcgguaacacuacccagccacucaacccgcaaacugcaaacgcgcucacaaacauggcuagaaucaagggaauacacaaaacaccuaauaaaagucgaaaacuggauauuccgcaaccccggcuucgcacuggucgcaguagcaauagcguggcuccuaggcucgaguaccucccaaaaagucauauaccucgucaugauccuccucauagccccagcauacuccauccgcugcaucggcgucagcaacagagacuucguagaaggcaugucuggaggcacauggguggacguggugcuagaacacggaggcugcgucaccguaauggcccaagacaaacccacagucgacaucgaacucgucacaaccacgguuagcaacauggcagagguacgcuccuacugcuaugaagccagcauaucagacauggcaagcgacucgcgcugccccacccaaggcgaagccuaccucgacaaacaaagugacacgcaauacguaugcaaaagaacccuagucgaccgaggcuggggaaacgguugcggccucuucggaaaaggcagccuaguaacaugcgccaaauucacaugcuccaagaaaaugacagggaaaagcauacaacccgaaaaccuggaauacagaaucaugcuuagcguacacggcagccaacauucagguaugauaguaaacgacaucggccacgaaaccgaugagaaccgcgccaaaguagaagucacccccaauuccccgcgcgccgaagcaacccuaggcggauucggaucacucggccuugacugcgaaccccgcacaggacucgacuucagcgaccucuacuaccuaacaaugaacaacaaacacuggcucguacacaaagagugguuucacgacaucccccuacccuggcacgccggagccgacaccggaacaccccacuggaacaacaaagaagcccuaguggaguucaaagacgcacacgccaaacgccaaaccguagucguccuaggcagccaagaaggcgccguccacacugcguuagcaggagcauuggaagccgaaauggacggggccaaaggucggcuauucagcggccaccugaaaugccgccucaaaauggacaaacuucgccuaaaaggcgucuccuauucacucugcaccgccguaugcacagcagccaaaguaccggcggaaacccuacacggcaccguaacggucgaaguacaauacgcaggaacagacgguccaugcaaaguacccgcucaaauggccguagacaugcaaacccucacccccguaggcagacuaaucaccgccaacccaguaauaaccgaaagcacggaaaacuccaaaaugaugcuagaacuagacccgcccuucggcgacagcuacaucgucauuggaguaggggacaagaaaaucacacaccacuggcacagauccggauccacaauaggcaaagcguucgaagcaaccguccgcggcgcaaaacgcauggccguccucggcgacacggcgugggacuucgguucaguaggcggagucuucaacucccuaggcaaaggaauacaccaaaucuucggcgccgcauucaaaucgcuguucggcggcaugucgugguucucacaaauacucaucgggacccuccuaguauggcugggacucaauaccaaaaacggaucaaucucacucacaugccuggcgcugggcggcguaaugauauuccuaucaacagcagucucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7381 - RNA, 2431 nt, Artificial Sequence
  KX601166.1 prME-short mRNA Design 2 opt
ggggcgcugccuacggagguggcagccaucuccuucucggcaucaagcuuaccaugacuagcaucggcaucgucggccuccuacugaccacagcuauggcagcagaaaucacccgacggggguccgcauacuacauguaccuagaccgcucagacgccggaaaagcgaucuccuucgcaacaacgcuaggagucaacaaaugccacguccaaaucauggaccuaggccacaugugcgacgcuacaaugagcuacgaaugccccaugcuagaugagggcguagaacccgacgacgucgacugcuggugcaacaccacuagcacguggguaguauauggcacaugccaccacaaaaagggagaagcacggcggagccgacgcgcaguaacacucccaagccacagcacacgaaaacuccaaacccguagccaaacguggcucgaauccagagaauacaccaaacaccuaaucaaaguagaaaacuggaucuuccgaaacccaggcuucgcccucguagcagucgcaauagcauggcuccuaggauccaguacaagccagaaaguaaucuaccuaguaaugauccuccuaauagcacccgccuacuccaucagaugcauaggcguaagcaaccgagacuuuguggaaggaauguccggcggaacauggguagacgucgugcuggaacacggaggcugcguaacgguaauggcgcaagacaaacccaccguagacaucgaacuggucaccaccaccguaucaaacauggcagaaguacgcuccuacugcuacgaagcgucaauaucagacauggccucggacucccggugcccaacccaaggcgaggcauaccuagacaaacaauccgacacccaauacgucugcaaacgaacccugguugaucgaggaugggguaacggcugcggacucuucgguaaaggcagucuagucaccugugcaaaauucacaugcucaaagaaaaugaccggaaaaucaauucaaccagaaaaccucgaauaucgaauaaugcucucaguacacggaagccaacacucaggcaugauagucaaugacgaaaaccgcgccaaaguugaagucaccccaaacagucccagagcagaagccacgcucggcggguucgggagccuaggacuggacugugaaccccggacgggccuggacuucagcgaccuauacuaccucaccaugaacaacaaacacuggcuaguacacaaagaaugguuucacgauauaccccucccguggcacgccggcgccgauaccggcacuccccacuggaacaacaaagaagcacuggucgaguucaaagacgcacacgcaaaacgccaaacugucguaguccucgggucccaagaaggcgccguacacacagcacucgccggcgcgcucgaggcagaaauggacggcgccaaagguagacucuucucaggacaccuaaagugccgccuuaaaauggacaaacuccgccucaaaggagugucguacuccuuaugcaccgccgcauucaccuucacaaaaguaccagccgagacacuccacggcaccguaaccguagaaguacaauacgccgggaccgacggaccaugcaagguacccgcacaaauggccguagacaugcaaacacucacgccagucggacgccucaucaccgcaaaucccgucaucacagaguccaccgagaacuccaaaaugaugcucgaacucgaucccccauucggcgacuccuacauagucaucggcgucggagacaagaaaaucacccaccacuggcaccgauccggcucgaccaucggcaaagccuucgaagccaccguaagaggcgccaaacggauggccguccugggcgacacggccugggacuucggauccgucgguggcguuuucaacucacucggaaaaggaauccaccaaaucuucggagccgccuucaaaucacuauucggaggcauguccugguucagccaaauccucaucggaacccuacucgucuggcuuggucucaacaccaaaaacggcagcaucagcuuaacaugccucgcacucggaggcguaaugaucuuucucuccaccgccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7382 - RNA, 2449 nt, Artificial Sequence
  KF383118.1 prME-short mRNA Design 2 opt
ggggcgcugccuacggagguggcagccaucuccuucucggcaucaagcuuaccaugacaagcauuggcauuauaggccuacuucucaccacugccauggccgccgaaauaacacgacgaggaagcgccuacuacauguaccuagacagaucggacgcaggcaaagcaaucagcuucgcaacaacccucggagucaacaaaugccacguacaaaucauggaccuaggacauaugugcgacgcaacaaugucauacgaaugccccaugcuggacgaaggcgucgaacccgacgacguagacugcuggugcaacaccacaaguaccuggguagucuacggaaccugccaccacaaaaagggagaaacccgacggucccgcagaucaguaucccuccgcuaccacuacacaagaaaacuccaaacccgaagccaaaccuggcucgaaucccgcgaauacaaaaaacaccuaaucaugguagaaaacuggauauuccggaacccaggauucgccaucgugaguguagccaucacauggcucaugggcagucugaccagccaaaaagucaucuaccucguaaugaucgugcuaauaguacccgccuacagcaucucaugcaucggcgucucaaaccgcgaccucguagaaggaauguccggaggcaccugggucgacgugguucucgaacauggaggaugcgugacggaaauggcccaagacaaaccaaccgucgacaucgaacucguaacgaugaccgucagcaacauggcagaagucagauccuacugcuaugaagcgucccucagcgacauggcaagcgccagccgaugccccacacagggcgagcccucacucgacaaacaaucagacacacaaagcgucuguaaaagaacccucggggaccgaggcuggggcaacgggugcggcauauucggaaaagguucgcuaguaacaugcucaaaauucaccugcugcaaaaaaaugcccggcaaaucgauacaaccagagaaccucgaauacagaauaaugcuacccguacacgggagccaacacagcggcaugauaguaaacgacauaggacacgagacagacgagaacagagcaaaaguagaagucacgccaaauuccccgcgagccgaagcaacacucggaggcuucggaagccuagggcucgacugcgaaccacgcaccggccucgacuucucagaccuauacuaccugaccaugaacaacaaacacuggcuuguccacaaagaaugguuccacgauaucccucuacccuggcacgccggagcagacaccggcacaccccacuggaacaacaaagaggcccugguagaguucaaagacgcacacgcaaaacgucaaaccgucguggucuuaggcagccaagaaggcgccguacacaccgcacucgccggcgcccucgaagcggagauggacggggcuaaaggacgccuguucucaggccaucucaaaugccgucuaaaaauggacaaacuaagacuaaaaggaguaucguacagccucugcaccgccgccuucacauucaccaaaguaccggcagaaacacugcacggaacagugacaguggaaguccaaagcgccggaacagauggacccugcaaaguccccgcccagauggccguagacaugcaaacacucacacccguaggccggcuaaucacagcaaacccgguaaucaccgagucaacagaaaacuccaaaaugaugcuggaacuggauccgccauucggagacucauacauagucauagguguaggagacaagaaaauaacccaccacuggcaccgaagcggcagcaccauaggaaaagccuucgaagccacgguacgcggagccaaaagaauggccgugcucggagacaccgccugggacuucggcucaguagggggcguauucaacagccuaggaaaaggcauacaccaaaucuucggagcagcauuuaaaagccuauucggaggaaugagcugguucucacaaauacuaaucggaacccuacuaguguggcuaggacucaacaccaaaaacggcagcaucucacucacgugccuagcccugggaggagucaugauauuccucuccacagccguauccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7383 - RNA, 2446 nt, Artificial Sequence
  KX447520.1 prME-short mRNA Design 2 opt
ggggcgcugccuacggagguggcagccaucuccuucucggcaucaagcuuaccaugagcguaggcauagucggccuacuccugacgaccgcaauggccgcagaagugacacggcggggcagcgccuacuacauguaucuggacagaaacgacgcgggggaagccaucucauucccaacgacccuaggcaugaacaaaugcuacauacaaauaauggaccuagggcacaugugcgacgcaacgauguccuacgagugcccgaugcucgacgaagguguagaaccagacgacgucgauugcuggugcaacaccacauccacauggguaguauacggcacuugccaccauaagaaaggggaagcacgccgcagccgacgcgccguaacacucccuagccacuccacgcgcaaacuacaaacaagaagccaaaccuggcuagaaucuagagaauacacgaaacaccugauaagaguagaaaacuggaucuuccgaaacccgggauucgcccucgccgcagccgccauagcauggcuccucggaagcaguaccagucaaaaaguaaucuaccugguaaugauccuccuaaucgcacccgcguacagcaucaggugcaucggcgugagcaaccgcgacuucguagaagggaugagcggcggaacaugggucgacgucguccuagagcacggaggaugcgucacaguaauggcacaagacaaaccuacgguagacaucgagcucgucaccaccaccguaaguaacauggccgaaguacggucauauugcuacgaagcauccauaagcgacauggccagcgacucccgauguccaacucaaggagaagcauaccuagacaaacaaucggacacacaauacguaugcaaaagaacccucguagacagaggauggggcaacggaugcggacuauucggaaaaggcucgcuaguaaccugcgccaaauucgcgugcuccaagaaaaugacaggaaaaagcauucaaccagaaaaccuagaauacagaauaaugcuguccguacacggaagccaacauagcggaaugaucgucaacgacaccggacacgaaacggacgagaacagagcaaaaguagaaaucaccccaaacaguccccgcgcagaggcgacgcuaggagguuucggaagccuaggacuggacugcgaaccccgcacgggccucgacuucagcgaccuguacuaccucaccaugaacaacaaacacuggcuagugcacaaagaaugguuucacgacaucccccuaccguggcacgcaggcgcagacacaggaacaccgcacuggaacaacaaagaagcacuggucgaguucaaagacgcccacgcaaaaagacagacaguggugguccugggcagccaagagggagccguacacacagcgcucgcgggagcacuggaagccgagauggacggcgcaaaaggacgccuguccucaggacaccucaaaugccgacuaaaaauggacaaacucagacucaaaggagucagcuacucacuuuguacagccgccuucacauucacaaaaauaccagccgaaacacuacacggaacaguaaccgucgaaguacaguacgcaggaacagacggaccgugcaaaguccccgcgcaaauggcaguagacaugcaaacccugaccccagucggacgacuaauaaccgcaaaccccguaaucacagaauccaccgaaaauuccaaaaugaugcucgagcuagacccacccuucggcgacagcuacauagugaucggcgucggggaaaagaaaauaacccaccacuggcaccgaagugggaguacaauaggcaaagcauucgaggcaaccgucagaggggccaaacgaauggcaguacugggagacacagcaugggacuucggaucagugggcggagcccuaaacucacucggaaaaggaauccaucaaaucuucggggccgcguucaaaucacucuucgguggcaugagcugguucagccaaauacucauaggcacacuccuaauguggcucggacugaacacgaaaaacggaagcauaagccugaugugccuggcacuaggcggcguccucauauuuuuaaguacagccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7384 - RNA, 2449 nt, Artificial Sequence
  KU761561.1 prME-short mRNA Design 2 opt
ggggcgcugccuacggagguggcagccaucuccuucucggcaucaagcuuaccaugaccuccguggggauagucggacuacuccugacaaccgccauggccgccgaaguuacccgacgaggcagcgccuacuacauguaccucgaccgcaacgacgccggcgaggcaaucuccuuccccaccacgcuaggcaugaacaaaugcuacauacaaaucauggaccucggacacaugugcgacgcaacaaugagcuacgaaugccccaugcucgacgagggagucgaacccgacgaugucgacugcuggugcaacacaaccagcaccugggucguguacggaaccugccaccacaaaaagggcgaagcgcgccgcucccggcgcgccgucacccuccccagccacucaacacgaaaacuacaaacacgaagccaaacauggcuggaaucacgagaauacaccaaacaccuaauacgagucgaaaacuggauauuccgaaaccccggcuucgcacuagccgccgcggccauagccuggcuccucggcucaucaaccucccaaaaaguaaucuaccucguaaugauacuccuaauagcccccgcauacucgauaagaugcauaggcgucagcaaccgcgacuucguagaaggaaugagcggcggcaccugggucgacguuguccuagaacacggcggaugcgucacaguaauggcccaagacaaaccuaccgucgacauagaacucgucacaacaaccguuuccaacauggccgaaguacgaucauacugcuacgaggcuucaauauccgacauggccucggacucccgcugccccacccaaggcgaagccuaccucgacaaacagagcgacacccaauacgucugcaaacgcacgcuagucgaccgcggauggggcaacggcugcggacuauucgggaaaggaucccuaguaacaugugcaaaauucgccugcucaaagaaaaugacggguaaaucaauccaaccggaaaaccucgaguaucgaaucaugcucuccguccauggcucccaacacuccggcaugauaguaaaugacacaggccacgaaaccgaugaaaacagagcuaaaguugaaauaacccccaacucaccacgcgccgaagccacccugggcggcuuuggaucacugggccucgacugcgaaccccgaaccggucucgacuucagcgaccuguacuaccuaacaaugaacaacaaacacuggcuaguccacaaggagugguuccacgacaucccacucccauggcacgccggagcagacacaggcaccccacacuggaacaacaaggaagcccuagucgaguucaaagacgcacacgcaaaacgacaaacggucgucguccuagggagccaagaaggagcaguacacacagcacucgcaggggcgcuagaagcagaaauggacggggcaaaaggacgccuuuccagugggcacuuaaagugcagacucaaaauggacaaacuuagauuaaaaggcguaucauacucacuaugcaccgccgccuucaccuucaccaaaauacccgccgaaacgcugcacggaacagucacgguugaaguccaauacgccggcacagacgggcccugcaaaguacccgcgcaaauggcggucgacaugcagacacuuacccccguuggucggcuaauaacggccaacccagucauaacagaaagcaccgaaaacuccaaaaugaugcuagaacucgacccacccuucggagacagcuacaucgucaucggcguuggcgaaaagaaaaucacacaucacuggcacagaucagguagcaccauaggcaaagccuuugaagccacagucagaggcgccaggcguauggcaguccucggagacaccgccugggacuuuggauccgugggaggcgcacuaaacucccuaggcaaaggcauccaucaaauauucggggccgccuucaaaucgcuguucggcggaaugucaugguucagccaaauccuaaucggaacgcuccuuauguggcucggccuaaacaccaaaaacggauccauaucccucaugugccuggcccucggaggcguccuaaucuuccuguccacagcggucuccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7385 - RNA, 2449 nt, Artificial Sequence
  KX806557.2 prME-short mRNA Design 2 opt
ggggcgcugccuacggagguggcagccaucuccuucucggcaucaagcuuaccaugaccuccguuggcaucgugggccuccuccuaacaaccgcaauggccgccgaaguaacccgacguggaagugcauacuacauguaccuagaccgcaacgacgcaggagaagcaaucucauucccaaccacccuaggcaugaacaaaugcuacauccaaaucauggaccuaggccacaugugcgacgcaaccaugucauacgaaugccccaugcuagacgaagguguugaaccagacgacguagacugcuggugcaacacaacauccaccuggguagucuacggcacaugccaccacaaaaagggagaagcacggcgcucccgccgagccgucacccugcccagucacuccacccgcaaacuccaaacccgaucccaaaccuggcuagaaagccgcgaauacacaaaacaccuaauaagaguagaaaacuggauguucagaaaccccggauucgcccucgccgcagcagccauagcauggcuccucggcucauccaccucacaaaaaguuauauaccucgucaugauccuacuaauagccccagccuauagcaucagaugcaucggcgucuccaaccgagacuucgucgaaggaaugucaggaggaaccuggguggacgucgugcucgaacacgggggcugcgugaccguaauggcacaagacaaaccaacgguagacaucgagcuagucacaacaacuguguccaacauggccgaaguacgaagcuauugcuacgaagcauccaucucggacauggccagcgacucucgaugccccacccaaggcgaagcauaccuggacaaacaauccgacacccaauacguaugcaaacguacucuaguagaccgcggcugggggaacgguugcggacuguucggaaaagggucacugguaaccugcgcaaaguucgcgugcucuaagaaaaugaccggaaaauccauccaaccagaaaaccuagaauaccgcaucaugcuauccguccacggaucccagcacaguggaaugauugucaacgacaccggacaugaaacagacgaaaaccgcgccaaaguagaaauaacaccaaacucaccccgcgccgaagcaacacucggcggauucggcucacucggacucgacugcgaaccccgcaccggccucgacuucucagaccuguacuaccucacaaugaacaacaaacacuggcucguacacaaagaaugguuccacgacauaccacucccuuggcacgcgggcgccgacacagguaccccacacuggaacaacaaagaagcccuagucgaguucaaagacgcacacgccaaaagacagacgguagucgugcucggaagccaggaaggagccguacacaccgcccucgccggggcacuggaagcagaaauggacggcgcuaaaggccgccucucauccggccaccuaaaaugccgguuaaaaauggacaaacugagacucaaaggaguaagcuacuccuuaugcaccgccgccuucaccuucaccaaaauaccggccgaaacccuccacgguaccguaacaguagaaguccaauacgccggaacagacggccccugcaaagucccugcccagauggcugucgacaugcaaacccucacccccgucggaagacuaaucacugccaaccccgucauaaccgaauccaccgaaaacagcaaaaugauguuggaacucgaucccccauuuggcgacucauacaucgugauaggcguaggcgagaaaaagauaacacaccacuggcaccguuccggaaguaccaucggcaaagcauucgaagcgaccguccgaggcgcaaaacgaauggccguacucggggacacggccugggacuucgggagcgugggcggcgcacuaaacucccucggcaaaggaauccaccaaaucuucggcgccgccuucaagucccucuucggaggcaugucgugguucucccagaucuuaaucggaacucuacucauguggcuaggguugaacaccaaaaacggaucaauaucccuaaugugcuuagcccuuggaggaguacuaaucuuccuaagcaccgcagugucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7386 - RNA, 2449 nt, Artificial Sequence
  LC191864.1 prME-short mRNA Design 2 opt
ggggcgcugccuacggagguggcagccaucuccuucucggcaucaagcuuaccaugaccaguguaggcauagugggacuacuacucacuaccgccauggcagccgaaguaacaaggcgaggauccgcguacuacauguacuuagaccgcaacgacgcaggagaagcaaucuccuuucccaccacacucggaaugaacaaaugcuacauccaaauaauggaccuaggccacaugugcgacgccacaauguccuacgaaugcccgaugcucgacgaaggagucgagccagaugacguagacugcuggugcaacaugaccagcaccugggucgucuacggcaccugccaccacaaaaaaggagaggcgcgaagauccagacgggccgucacacuaccaagucacuccacgcguaaacuccagaccagaagccaaaccuggcucgaaucgcgagaauacacaaaacaccuaauccgcgucgagaacuggauauuccguaaccccggauucgcccuagcagccgccgcaaucgccuggcuacuaggcagcucaaccagccaaaaaguuaucuaccuugucaugauacuccucauugcgccagcauacucgaucagauguauuggugucaguaaccgcgacuucguagaaggcauguccggcggaacaugggucgacgucguucucgaacacgggggaugcgucaccgucauggcacaagacaaaccaaccgucgacauagaacucguaacuacaaccgucuccaacauggccgaaguccgcagcuacugcuacgaagccagcaucucagacauggcgagcgauucccgcugccccacgcaaggcgaagccuaccuagacaaacaaagcgacacccaauacguauguaaacggacccucgucgacagaggauggggcaacggcugcggccuuuucggcaaaggcagccuaguaaccugcgccaaauucgccugcagcaaaaaaaugaccggaaaaagcauucaaccugaaaaccuagaguaccgcaucaugcucuccguccacggaucgcaacacuccggcaugauagucaaugacaccggacacgaaaccgacgaaaaccgugcgaaaguggaaaucaccccuaauagccccagggccgaagccacacucggcggauucggcagccuagggcuagacugcgaacccagaacaggccuagacuucagcgaccuauacuaccucacaaugaacaacaaacacuggcuaguccacaaagaaugguuccacgacaucccacuaccauggcacgcuggagccgacacagggacuccccacuggaacaacaaagaagcgcucguagaguucaaagaugcacacgcaaaacggcaaacagucguaguccuaggcucacaggaaggcgcgguccauacagcccucgcaggagcacucgaagcagaaauggacggagccaaaggccgacuaagcagcgggcaccucaaaugcagacucaaaauggacaaacucagacugaaaggcguaagcuacagccuuugcacagcagccuucaccuuuaccaaaauacccgccgaaacccuacacggcaccguaacgguagaaguucaauacgcaggcaccgacggaccaugcaagguccccgcacaaauggccgucgauaugcagacccuaacccccgucggacgccucaucaccgccaacccagucauaaccgaaagcacagaaaacucgaaaaugaugcucgaacuagacccacccuucggagacucauacaucguaaucggagucggagaaaaaaaaauaacacaucacuggcaccgauccggcucaacaauaggcaaagccuucgaagcaacaguacgaggagcgaaacggauggccguacucggagacacagccugggacuucggcagcgucggaggagcccucaacagcuuaggaaaaggcauccaccaaauauucggagccgcauucaagucccuguucggcggcauguccugguucagccaaauacuaauaggcacgcuacugauguggcucggacucaacaccaaaaacggcagcaucagccucaugugccucgcgcucggaggcguccucauauuccuuucaaccgcagucucagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7387 - RNA, 2449 nt, Artificial Sequence
  KU744693.1 prME-short mRNA Design 2 opt
ggggcgcugccuacggagguggcagccaucuccuucucggcaucaagcuuaccaugacaagcgucgggaucgugggccuccuacuaacgaccgcaauggcagcagaggucacccgcagaggaagcgcauacuacauguaccuagaccgaaacgacgccggagaagcaaucagcuuccccacaacccucggcaugaacaaaugcuacauacagaucauggaccuaggacacaugugcgacgccaccaugagcuacgaaugcccgaugcuagacgaaggcgucgaaccagacgacgucgacugcuggugcaacacaacaagcacauggguagucuacggaaccugccaccauaagaaaggcgaagcgcgcagaagccggcgagcaguaacccuaccaagccacuccacaagaaaacuacaaaccagaucacagaccuggcucgaaagccgggaauacaccaaacaccucauccgcgucgaaaacuggaucuucagaaaucccggcuucgcccuagcggcagccgccaucgccuggcuauuaggcagcaguaccucccagaaaguaauauacuuagucaugauacuacuaauagcgccagcguacucgauacgaugcauaggagucagcaaccgagacuucgucgaaggcaugagcggagggacguggguggacguaguacucgaacacggaggcugcgucacggcgauggcucaagacaaacccacagucgacaucgagcuagucaccacaaccguaagcaacauggccgagguaagaucauacugcuacgaggcauccauaagcgacauggcaagugacucaagaugccccacacaaggagaagcauaccucgacaaacaguccgacacccaauacgucuguaaaagaacccuaguagacagaggcuggggcaacgggugcggacuauucggcaaaggcagccucgugacaugcgcgaaauucgcuugcuccaagaaaaugacaggcaaauccauccaacccgaaaaccucgaauaccgcauaaugcuaagcguacacgggucccaacacuccggcaugcuggugaacgauaccggacacgagaccgacgaaaacagagcgaaaguagaaauaaccccaaauagcccgcgagcagaagcaacucuaggcggauucggcagccuuggacuagacugcgaaccaagaacaggccucgacuucucagaccuauacuaccucaccaugaacaacaaacacuggcucgcgcacaaagaaugguuccacgauaucccccuccccuggcacgcaggcgcagcaacgggaacaccacacuggaacaacaaagaagcccucgucgaguucaaagacgcgcacgccaaaaggcaaaccgucguaguacuaggaucccaagaaggagccguccacaccgcacucgccggagcacuagaagccgagauggacggcgcaaaaggacgacucuccagcggccaccucaaaugccgacucaaaauggacaaacugcgccuuaaaggcgucucguacuccuuaugcacggccgccuucaccuuuacaaaaauacccgcagagaccguagacggcaccgucaccguagaagggcaguacgggggaaccgauggaccuugcaaaguaccagcccaaauggcaguagacaugcagacccuuacacccguaggacgacuaauaacagccaaccccgucauaaccgaauccaccgaaaacagcaaaaugaugcuagaacuagaucccccauucggcgacucauacaucgugaucggggucggagaaaagaaaauaacccaccacuggcacaggagcgggagcacaaucggcaaagccuucgaagccaccguacggggcgccaaacgaauggccguucucggcgacacagcaugggacuucggcucggucggcggagcacuaaacagccucggaaaaggaauacaccaaauaauaggcgcggccuucaaaucacuauucgggggcaugagcugguucagccaaauacugauagggacgcugcugauguggcucggacugaauacgaaaaacggcuccaucagucuaaugugccuagcccuaggaggcguacugauauuccucagcacagcaguauccggcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7388 - RNA, 2440 nt, Artificial Sequence
  KU963574.2 prME-short mRNA Design 2 opt
ggggcgcugccuacggagguggcagccaucuccuucucggcaucaagcuuaccaugggcgccgacgccagcaucggcaucgucucccuacuccuaacaaccguaauggcagcagagauaacgcgacgaggauccgcguacuacauguaccuagacagaagcgacgccggcaaggccaucucauucgucacaacgcuaggcgucaacaaaugccacguucaaauaauggaucucggccacaugugugacgcuaccaugagcuacgaaugcccaaugcucgacgagggcgucgaacccgacgacguggacugcuggugcaacaccaccucaacaugggucguauauggcacgugccaccacaagaaaggcgaagcccgccgaucaaggagagccgucacccucccaagccacucaaccagaaaacuccaaaccagaagccagaccuggcucgagagccgagaauacacaaaacaccugauaaaaguagaaaacuggaucuuccgaaacccaggcuucgcgcuagucgcaguagccauagccuggcuccucggcagcuccacaucacagaagguuauauaccuagucaugauacuccucaucgccccagcauacagcauccgcugcauaggcguaagcaaccgcgacuucgucgaggggauguccggaggaacgugggucgacguagugcuagaacacgguggcugcguaaccgucauggcgcaagacaaaccgaccgucgacaucgagcuagucacaacgacaguaucaaacauggccgaaguacgaagcuacugcuacgaagccagcaucagcgacauggccucagacagcagauguccaacccaaggagaagcauaccucgacaaacaaagcgacacgcaauacgucugcaaacgcacccuaguagaccguggauggggcaacggcugcggccuguuuggaaaaggcucacuggucacaugugccaaauuuacaugcagcaagaaaaugacgggcaaaagcauacaaccagaaaaccuagaauaccgcaucaugcuaagcguccacggaagccaacacuccggaaugauagucaacgacgaaaaccgagcaaaagucgaaguaacacccaacucaccaagagcagaagcaacacucggcggcuucggaagccugggccuagacugcgaacccagaaccggacuagacuucagcgaccuguacuaccucaccaugaacaacaaacacuggcucguccacaaggaaugguuccacgacauaccacuaccauggcacucaggagccgacaccgaaaccccacacuggaacaacaaagaagcacugguggaauuuaaagacgcacacgccaaaagacagaccgucguaguccucgggagccaagaaggcgccguccauacagcacuggccggagcccuagaggccgaaauggacggagcaaaaggacgccuaucauccggccaccucaaaugccgccucaaaauggacaaacuccgacuaaaaggcguauccuacucccugugcaccgccgcauucacauucacaaaaguaccagccgaaacacugcacggcacggugaccguagaaguccaauacgcaggacgcgacggcccaugcaagguccccgcacaaauggcaguagacaugcagacauuaacgccagucggaagacucauaaccgccaaccccgucauaacugaaagcaccgaaaacucaaaaaugaugcuugaacuagacccacccuucggagacuccuauaucgucauaggaguaggcgacaagaaaauaacacaccacuggcacagaucaggcagcauaaucgggaaagccuucgaggccacaguccgcggcgccaaacgcauggcaguccuaggggacacagcaugggacuucggcuccgugggcggaguuuucaacucccuaggaaagggaauccaccaaaucuucggcgccgccuucaaaucacucuucggaggaauguccugguucucucaaauccuaaucggaacccuacucgucuggcucggccuaaacaccaagaacggcagcauaagccuaaccugccucgcgcucggaggcguaaugauauuccucucaacugcggucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7389 - RNA, 2458 nt, Artificial Sequence
  KF383120.1 prME-short mRNA Design 2 opt
ggggcgcugccuacggagguggcagccaucuccuucucggcaucaagcuuaccaugggagcagacaccagcaucggaaucauaggacuacuccuaacaacagcuauggcggccgaaaucacgagaagaggaagcgcauacuauauguaccucgaccguuccgacgcaggcaaagcgauaucauucgcaaccacaaugggcgugaacaaaugccacguccaaaucauggaccuaggucacaugugugacgccaccaugucuuacgaaugccccaugcucgacgaaggagucgaacccgacgacguagacugcuggugcaacaccaccuccacauggguuguguacggaacaugccaucacaagaaaggagaagcccggccgucccgccgcgcaguaacgcucccgagccacuccaccagaaaacuacaaacccgcucacaaacauggcucgaaagucgcgaguacacaaaacaucucauaaaagucgaaaacuggauacuacgcaacccaggcuucacaguggccgcgcucgccauggccuggcuacugggaaacaguacgagccagcgcguaaucuaccucguaaugauucuccugaucgcacccgcauacuccauacgcugcaucggcguuagcaaccgcgacuucguagaaggaauguccggaggaaccuggguagacgugguccuagaacacggaggaugcgucaccgucauggcccaagacaaaccaacagucgacauagagcuaguaacaaccacggucuccaacauggccgaagucagaagcuacugcuacgaagcauccaucagcgacauggcaagcgacucccgcugucccacacaaggggaagccuaccucgacaaacaguccgacacacaauacgucugcaaacgaacccucguggaucgcggauggggcaacggaugcggacucuucggaaaaggaagccuagugaccugugcaaaguucacgugcuccaagaaaaugacaggaaaauccauacaacccgaaaaccucgaauaccggaucaugcucagcguccacggaucccagcacagcggaaugauagugaacgacauaggccacgaaaccgacgaaaaccgagcaaaaguggaagucaccccuaauucaccccgcgcagaagcaacacugggcggcuucggcagccucggccuagacugcgaaccgcgcaccggacuagacuuuucagaccuguacuaucuaacaaugaacaacaaacacuggcuuguccauaaagaaugguuccacgacaucccccucccauggcaugcaggcgcagacacaggcacaccccacuggaacaacaaagaggcacucguggaguucaaagacgcacacgccaaaagacaaaccgucguaguacucggcucccaagaaggagcaguccacaccgcucuggcaggagcauuggaggcagaaauggacggcgcgaagggccgacucuucucaggacaccucaaaugccggauaaaaauggacaaacuaaggcuaaaaggcgucagcuacucacucugcaccgccgcauucacauucagcaaagucccggcagaaacgcuccacggaacagucacgguggaggugcaauacgccggccgagacggacccugcaaaguccccgcccaaauggcaguagacaugcaaacgcucacccccguaggaagacuuaucacggccaacccaauaauaacagaauccaccgaaaacagcagaaugaugcucgagcucgacccucccuucggcgacucauacauaguuaucggaguaggcgacaagaaaaucacgcaccacuggcacaggucaggcagcacaaucggaaaagccuucgaagccaccguccgcggcgcaaaaagaauggccguacucggcgacacagccugggacuuuggaagcgucggcggagucuucaacucacuagggaaaggaguucaccaaguauucggagccgccuucaaaucgcuauucggcgggauguccugguucucgcaaauccucaucggaacccuucuagucuggcucggacugaacaccaaaaacggaagcaucucccuagcaugccuagcccucggcggugcaaugauauuccuaagcacggccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7390 - RNA, 1741 nt, Artificial Sequence
  KU321639.1 solE mRNA Design 2 opt
ggggcgcugccuacggagguggcagccaucuccuucucggcaucaagcuuaccaugucgcaaaaggucauauaccuggucaugaucuuacucauagccccggcauacagcauaagauguauaggagucucgaacagagacuucgucgaaggaaugagcggaggcacguggguggacauaguccuggaacacggaggaugcgugaccgugauggcgcaagacaaaccgaccguggacauagaacugguaacaaccacggucucgaacauggccgaggucaggagcuacugcuacgaagcaagcauaagcgacauggcaagcgauaguagaugcccgacacaaggcgaggcauaucuagacaaacaaagcgauacccaauacguauguaagcgcacauuaguggaccgaggauggggaaacggcugcggacuguucgggaaaggaagccuagucacgugugcgaaguucgcgugcagcaagaaaaugaccggcaaaucgauacaacccgagaaccuagaauacagaauaaugcuaagcguacacgggagccagcacucgggcaugaucguaaacgacaccggacacgagaccgacgaaaaccgagcgaaaguggaaauaacacccaacucgccccgagcagaggccacccuaggaggauucggcucgcucgggcuagacugcgagcccaggacuggucuagacuucucagacuuguacuaccucacgaugaacaacaagcacuggcuaguacacaaggaaugguuccacgacauaccacugcccuggcacgcgggagccgacacagguacaccccacuggaauaacaaggaggcccucguggaguucaaagacgcccacgcaaaacgccaaaccgugguaguacucggcagccaggaaggggccguccacacggcccuggcaggggcacuggaagcggaaauggacggggcaaagggcagacuaucgagcggacaccuaaaaugucgccuaaaaauggacaagcuaaggcucaagggcguaaguuacagccuaugcacggccgcauucacguucacgaaaauacccgcagaaacgcuacacggcacggucacggucgagguccaauacgcgggcacagacggacccugcaaagugcccgcgcaaauggccguggacaugcaaacgcucacgcccgucggacggcucauaaccgcaaacccgguaauaaccgaaaguacggaaaacagcaaaaugaugcucgaguuagacccaccauucggggacucauacauaguaauaggcgugggcgagaaaaagauaacgcaccacuggcaccgcucgggaucuaccaucggcaaggcuuuugaagcaacaguacgcggggcaaaacgcauggccgugcucggggacacggccugggacuuuggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7391 - RNA, 1741 nt, Artificial Sequence
  KU312312.1 solE mRNA Design 2 opt
ggggcgcugccuacggagguggcagccaucuccuucucggcaucaagcuuaccaugucgcaaaaagucaucuaccuagucaugauccuacucauagcccccgccuacagcauccgcugcaucggagucucaaaccgcgacuucguugaaggcaugucaggaggcacaugggucgacgugguacuagaacacggcgggugcgucacagucauggcccaagacaaacccacaguggacaucgaacuggucaccaccacaguaucaaacauggcagaaguuagaagcuacugcuacgaggcaagcauauccgacauggccagcgacucaagaugcccaacacaaggcgaagccuaccuggacaaacaaagcgacacucaauacguaugcaaacgaacgcuaguggacagaggauggggaaacggauguggccucuucggcaaaggcagccucgucacaugcgcaaaauucgccugcucaaagaaaaugaccggaaaauccauucaacccgagaaccuagaauacagaaucaugcuauccgugcacggcagccaacacuccggaaugauagucaacgacaccggccacgaaaccgacgaaaaccgcgcaaaaguggaaauaaccccaaacucacccagagccgaagcaacacuaggcggcuucggcucccucggacuagacugcgaacccagaaccggccucgacuucucagaccuauacuaucuaaccaugaacaacaaacacuggcucgugcacaaagaaugguuccacgacauaccccuacccuggcacgcaggggccgauacaggcacaccccacuggaauaacaaagaagcccucguagaguucaaagaugcacaugcaaaacgacagaccguagucgugcucggcagucaggaaggcgccguccacacggcccuggccggagcccucgaagcagaaauggacggcgcaaaaggccgacucuccagcggacaccuaaaaugccgccuaaaaauggacaaacuacgccucaaaggcgucagcuacagccucugcacagcagcauucacguucacaaaaauaccagcagaaacacuccacggcacaguaacagucgaaguccaguacgccggcacagacggacccugcaaaguaccagcacaaauggcaguagacaugcaaacgcucacgcccguaggacgccuaaucaccgcaaauccagucaucaccgaaagcaccgaaaacagcaaaaugaugcucgaacucgaucccccauucggcgacucguacauagucaucggcgugggagaaaagaaaaucacacaccacuggcaccgcuccggaagcaccauaggcaaagccuucgaagccaccguacgcggagccaaacgcauggcaguacucggagacacagccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7392 - RNA, 1729 nt, Artificial Sequence
  AY632535.2 solE mRNA Design 2 opt
ggggcgcugccuacggagguggcagccaucuccuucucggcaucaagcuuaccaugucgcaaaaaguaauauaccuagucaugauccuacucaucgccccagcuuacagcauacgcugcaucggggucucaaacagggacuucgucgaaggcaugagcggaggaacauggguggacgugguacuagaacacggcggaugcguaaccguaauggcgcaagacaagccuaccguagacaucgaacuaguaaccaccacagucuccaacauggccgaagucaggaguuacugcuacgaagcaagcauaagcgacauggcgagcgacagccggugcccgacacaaggugaagcauaccuagacaaacaaagugacacccaauacgucugcaaaaggacccuaguagacaggggcuggggcaacggcugcggucuauucggaaaaggcagccuagucacaugcgccaaauucaccugcagcaaaaaaaugaccggcaaaucaauccaacccgaaaaccucgaauaccgcauaaugcugagcgugcacgggucacaacacucgggaaugaucggauacgaaacagacgaagaccgcgcaaaaguagaaguaacaccgaacucgccaagagcagaagccacccucggaggauucggcucucucggacucgacugugaaccaagaaccgggcuagacuucucagaccucuacuaccuaacgaugaacaacaaacacuggcucgugcacaaagaaugguuccacgacauaccccugcccuggcacgcaggcgcagacacgggcaccccacacuggaacaacaaggaagcacuaguagaauucaaagacgcccacgccaagcgucaaacaguagucgugcucgggagccaagaaggggccguacacacggcccuagcaggggcccuagaagcagaaauggacggggcaaaaggaagacuauucuccggacaccugaaaugccgccuaaaaauggacaaacucagacuaaagggcguaagcuacagccuaugcacagccgcauucacauucacaaaaguccccgcagaaacacuacacggcaccgucaccgucgaaguccaauacgcgggcacagacggcccauguaaaauaccaguacaaauggcaguagacaugcaaacacucacgccggugggcagacucauaacagcaaacccagucauaaccgaaagcacagaaaacaguaaaaugaugcuugaacucgacccacccuucggugacucguacaucgucauaggaguaggcgacaaaaaaaucacgcaccacuggcaccgaucagggucaaccauuggcaaagcauucgaagcaacaguacgcggggccaaacgcauggccguccuaggggacaccgccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7393 - RNA, 1741 nt, Artificial Sequence
  KU527068.1 solE mRNA Design 2 opt
ggggcgcugccuacggagguggcagccaucuccuucucggcaucaagcuuaccaugucccaaaaaguaauauaccuaguaaugauccuccucaucgcaccggccuauaguauccguugcauaggagucagcaacagagacuuuguagaaggcaugagcggcggcaccugggucgacgucguccuggaacacggaggaugcgugaccguaauggcacaagacaaaccgaccguggacaucgaacuggucacaacaacagucucaaacauggccgaagucagaagcuacugcuacgaagcaagcauaagcgacauggcgagcgacagccgaugcccaacccagggagaagcauaccucgacaaacagagcgacacacaauacguaugcaaacgaacgcucguagacaggggcuggggcaacggaugcggccuauucggaaaagggagccuagucacgugcgcgaaauucgccugcagcaagaaaaugacaggaaaaucaauccagccagaaaaccuagaguaccgaaucaugcugagcguacacgggagccaacacucaggcaugaucguaaacgacaccggacacgaaaccgacgaaaaccgcgcaaaaguagaaauaaccccaaacucaccaagggccgaagcaacgcuaggcggauucggcucacucggacucgacugcgagccaagaaccggacucgacuucagugaccuguacuaccucacaaugaacaacaaacacuggcuaguacacaaagaaugguuccacgacauaccacuccccuggcacgcgggcgcagacacgggcacaccacacuggaacaacaaagaagcccucguagaguucaaagacgcacacgccaaacgacagaccgugguaguacucggaagccaggaaggggccgugcacaccgcccuggccggcgcccuggaagccgaaauggacggagcaaaaggccgccucucaagcgggcacuuaaaaugucgccuaaaaauggacaaacucagguuaaaaggcguaagcuacagucuaugcacggccgcauucacauucaccaaaauaccagcggaaacgcuacacggcacagucacggucgaaguccaauacgcgggcacagacgggcccuguaaaguaccagcacaaauggccguagacaugcaaacacuaacaccggucggccgacucauaaccgcgaacccagucauaaccgaaagcacagaaaacaguaagaugaugcuagaacuagaucccccauucggagacagcuacauagucauaggcguaggugagaaaaagauaacacaccacuggcacagaagcggaucaaccauaggaaaggccuucgaagcaaccgugagaggggcaaaaagaauggccguacucggcgacaccgccugggacuucggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7394 - RNA, 1741 nt, Artificial Sequence
  KX421193.1 solE mRNA Design 2 opt
ggggcgcugccuacggagguggcagccaucuccuucucggcaucaagcuuaccaugucgcaaaaaguaaucuaccuagucaugaucuugcuaauagccccggccuacagcauacgcugcaucggaguaucaaacagggacuucgucgaaggaaugagcggaggcacguggguagacgugguacuagaacacggcggaugcgucaccguaauggcgcaagacaaaccaaccguggacaucgaacucguaacgaccacgguaucaaacauggccgaaguaagaagcuacugcuacgaagcaagcaucagcgacauggcaagcgauagccggugcccgacccaaggagaagcauaccuagacaaacagagcgacacccaauacguaugcaaacgaacccuaguagacaggggcuggggcaacggcugcggacuauucggaaaagggagccuagucacaugcgccaaauucacaugcagcaagaaaaugaccgggaaaucaauccagcccgaaaaccuagaauaccgcauaaugcuaagcgugcacgggagucagcacucuggcaugaucgugaacgacacgggauacgaaacagacgaaaacagagcaaaaguagaaguaacaccaaacuccccaagagccgaagccacgcucgggggauucggaucgcucggacuagacugcgaaccccguaccgggcuagacuucucagaccuauacuaccuaacaaugaacaacaaacacuggcucguacacaaagaaugguuccacgacauaccacugcccuggcacgcgggcgccgacacuggaacaccacacuggaacaacaaagaagcccuaguagaguucaaagacgcacaugcaaagagacagaccguggucguacugggaagccaagaaggagcaguacacacagcacuagcaggggcacuagaagcggaaauggacggggccaaaggaaaacuauucaguggacacuuaaagugcagacuaaaaauggacaaacuaagacucaagggcguaagcuacagccuaugcacagcagcguucacguucacgaaagugccagcggaaacgcuacacggaaccgucacugucgaaguccaauacgcgggcacagacgggcccugcaaaauccccguccaaauggccguagacaugcaaacgcuaacacccgugggaagacuaauaaccgcaaacccagucauaacagaaagcacggaaaauagcaaaaugaugcucgaacuagacccaccguucggagacagcuacauaguaauaggcguaggagacaagaaaaucacccaccacuggcaccgcucgggcucaaccauaggaaaagccuucgaagcgaccguacgcggagccaaacgaauggccguacuaggagacacggcaugggacuucggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7395 - RNA, 1741 nt, Artificial Sequence
  LC002520.1 solE mRNA Design 2 opt
ggggcgcugccuacggagguggcagccaucuccuucucggcaucaagcuuaccaugucacagaaaguaauauaccuaguaaugauacuccucauagccccggccuacuccauacgcugcaucggagucagcaacagagacuucguagagggaaugagcggcggaacauggguagacgugguccuagaacacggcggaugcguaacaguaauggcacaagacaaaccaaccguggacauagaauuggucacaaccacaguaucgaacauggccgaagucagaaguuacugcuacgaagcaagcauaagcgacauggcaagcgacagccgcugccccacccaaggagaggcauaccucgacaaacaaagcgacacacaauacguaugcaaacgaacacucguagaccggggcugggguaacggcugcggccuauucgggaaagggagccuagucacaugcgcgaaguucacaugcagcaagaaaaugaccggcaaaagcauccagcccgagaaccuagaauacagaauaaugcucagcgugcacgggagccaacacucgggcaugaccguaaacgacaucggcuacgaaacagacgaaaaccgcgccaaaguagaaguaaccccgaacucgccaagagccgaagccacccuagguggauucggaucccucggacucgacugcgaaccaagaaccggacucgacuucucggaccuauacuaccucacgaugaacaacaaacacuggcuaguacacaaagaaugguuccacgacauaccccuacccuggcacgccggagcagacacaggcacgccacacuggaacaacaaagaagcgcuaguagaguucaaagacgcccacgccaaacgacaaacagugguaguguuaggaagccaagaaggggcaguccacacagcccuggcaggagcacucgaagcagaaauggacggagccaaaggcaaacucuuuagcggacaccucaaaugccgccuaaaaauggacaaacuccgccuaaagggcguaaguuacagccugugcacggcagcguucaccuucacaaaagugcccgcggaaacacuccacggcaccgucacggucgaaguccaauacgcaggaacggacggacccugcaagauacccguacaaauggcaguagauaugcagacucucacccccgucggaagacucauaaccgccaacccgguaauaacagaaagcacagaaaacagcaaaaugaugcucgaacucgacccaccauucggggacucauacauagugaucggcgugggcgacaagaaaaucacccaccacuggcaucgcucgggcagcaccauaggcaaagccuucgaagcaacaguccgcggggcaaaacgaauggccguauuaggggacaccgcaugggacuucggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7396 - RNA, 1723 nt, Artificial Sequence
  DQ859059.1 solE mRNA Design 2 opt
ggggcgcugccuacggagguggcagccaucuccuucucggcaucaagcuuaccaugucccaaaaggucauauaccuuguaaugauccuacucauagcuccagcauacagcauacgcugcauaggcguaucaaacagagacuucguagaaggcaugagcggaggaacaugggucgacguaguacucgaacacggaggcugcgucacaguaauggcacaggacaaaccgaccguggacauagaacucgucacaaccacagucuccaacauggccgaaguaagaagcuacugcuacgaagcaagcaucagcgacauggcgucagacagccgaugcccaacacaaggcgaagccuaccuggacaaacagagugacacccaguacgugugcaaacggacacuuguagacagaggcuggggcaacggcuguggccuguucggaaaagggagccuagugaccugcgcaaaauucacaugcagcaagaaaaugacaggcaaaucaauccaaccagaaaaccucgaauacagaauaauguuauccguccacggaagccaacacuccggcaugauaguaaacgacgaaaaccgcgccaaaguagaaguaacaccaaacucacccagagccgaagccacgcucggcggcuucggaucgcuaggccuagacugcgaaccccgaacagggcucgacuucagcgaccucuacuaccucacgaugaacaacaaacacuggcuaguacacaaagaaugguuccacgacaucccccuacccuggcacgcaggcgcagauacaggcacaccgcacuggaacaacaaggaagcgcucguggaguucaaagacgcacacgccaagagacaaaccguagucguacuaggaagucaggaaggcgccguacacaccgcccucgccggagcacucgaagcagaaauggacggagcaaaaggaagacucuucagcggacaccucaaaugccgccucaaaauggacaagcuaagacucaaaggcguaagcuacagccuaugcacagccgccuucacauucacaaaaguacccgccgaaacacuccacggcacagucaccgucgaaguccaauacgccggcacagacggacccugcaaaguacccgcacaaauggccgucgacaugcaaacgcucacacccgucggcaggcucauaaccgcaaacccggucaucaccgaauccacggaaaacaguaaaaugaugcucgaacuagaucccccauucggcgacucguacauaguaauaggcgucggcgacaagaaaauuacacaccacuggcaccgauccggaagcaccauaggcaaagccuucgaagcaacaguccgcggcgccaaacgcauggccguacuaggggacacggcaugggacuuuggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7397 - RNA, 1729 nt, Artificial Sequence
  KU963573.2 solE mRNA Design 2 opt
ggggcgcugccuacggagguggcagccaucuccuucucggcaucaagcuuaccaugucacaaaaagucauauaccuaguaaugauacugcuaauagcaccagcauauagcauacgcugcaucggagucuccaacagagacuucgucgagggcaugagcgggggaacguggguggacguaguacucgaacacggcggaugcgucaccgucauggcacaagacaaaccaacaguagacauagaacuggucacaaccaccgucucaaauauggccgaagucagauccuacugcuacgaagcaagcaucuccgacauggcaagcgacagccgaugcccaacccaaggcgaagccuaccucgacaaacaaucagacacgcaauacguuugcaaacgaacccucgucgaccgaggcuggggcaacggcugcggccucuuugggaaaggaagccuaguaacaugcgcgaaauucacaugcuccaagaaaaugaccggcaaaucaauccaaccagagaaccuagaauaccgaaucaugcugagcguacacggcagccaacacucaggaaugauaggguacgaaaccgacgaaaaucgagccaaagucgaagucaccccaaacagcccacgagccgaagccacccucggaggcuucggaucacucggacucgacugcgaaccccggaccgggcucgacuucucagaccuguacuaccucacaaugaacaauaaacacuggcucguacauaaagaaugguuucacgacauaccccuccccuggcacgccggcgcagacaccggcacaccacacuggaacaacaaagaagcacucguggaguucaaagacgcccacgccaaacgccagaccgucgucguacuaggcucacaagaaggagcaguccacacagcccuagcaggggccuuagaagcggaaauggacggcgcaaaagggaaacucuucagcggacaccugaaaugccgccuaaaaauggacaaacuacgacucaaaggcguaagcuacagucuaugcacggccgcauucaccuucaccaaagucccagcagaaacacuccacggcacagucacaguagagguucaauacgcaggcacagacggccccugcaaaauacccguccaaauggccguagacaugcaaacccuaacccccgucggcagacuaaucacagccaacccggucaucacagaauccacagaaaacagcaaaaugaugcucgaacucgacccaccauucggagacucuuacauagucauaggaguaggcgacaagaaaaucacgcaccacuggcaccgauccggcuccacaauaggcaaagccuucgaagcaaccgugcgcggcgcaaaaagaauggcaguccucggagacaccgccugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7398 - RNA, 1741 nt, Artificial Sequence
  KY075939.1 solE mRNA Design 2 opt
ggggcgcugccuacggagguggcagccaucuccuucucggcaucaagcuuaccaugucgcagaaagucauauaccuggucaugauccugcucauagccccagccuacagucuacgaugcaucggaguaagcaacagagacuucgucgaaggaaugaguggaggcacauggguggacgucguccuggaacacggcgggugcgucacaguaauggcacaagacaaacccaccguagacaucgagcuagucacaaccacagucuccaacauggccgaagucagaagcuacugcuacgaagcaagcauaucagacauggcaagcgacagcagaugcccgacccagggggaggccuaccucgacaaacaaagcgacacccaauacgucugcaaacgcacccuaguggacaggggcuggggcaauggcugcggccuguucggaaaaggcagccuggucacaugcgcaaaauucgccugcucaaagaaaaugacaggaaaaagcauccaacccgaaaaccuggaauaucgcauaaugcuaucaguccacggcagccagcacucaggcaugauagugaacgacaccggacacgaaacagacgaaaaccgcgcaaaaguagaaauaaccccaaacucaccccgagccgaagcaacgcuuggcggcuucggaucacuuggacucgacugcgaaccaagaaccggacuagacuucagugaccucuacuaccucaccaugaacaacaaacacuggcucgugcacaaagaaugguuccacgacauaccauuacccuggcacgcgggcgcagacacuggaacaccccacuggaacaacaaagaagcgcucguggaguucaaagaugcccacgccaaacgccagaccguggucguacucgggagccaggaaggagcaguacacacggcccuagcaggggcccuagaagcagaaauggacggagcaaaaggcagacucucaagcggacacuuaaaaugccgccugaaaauggacaaacuacggcuaaaaggaguaaguuacagccucugcacagccgcauucacguucacgaagauaccggccgaaacacuccacggaacagucacgguagaaguccaauacgcgggcacggacgggccaugcaaaguacccgcgcaaauggcaguagacaugcaaacgcuaacacccgugggccgacucauaacagcaaaccccgucauaaccgaaagcaccgaaaacagcaaaaugaugcucgaacucgaucccccguucggagacucauacauaguaauaggcguaggagaaaagaaaaucacgcaccacuggcaccgcucaggaucaaccauaggcaaagccuucgaagccacaguaagaggggccaaacgcauggcagugcuaggcgacacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7399 - RNA, 1741 nt, Artificial Sequence
  KX447516.1 solE mRNA Design 2 opt
ggggcgcugccuacggagguggcagccaucuccuucucggcaucaagcuuaccaugagcaaaaaagucauauaccucgucaugauccuccuuauagcccccgccuacucaauccgcugcaucgguguaagcaaccgcgacuucguugaaggaauguccggcggaaccugggucgacgucguccucgaacacggcggcugcgugacugucauggcacaagacaaacccaccguagacaucgaacucgucacaaccaccgucucgaacauggccgagguacggagcuacugcuacgaagcauccauaucagacauggccuccgacuccagaugcccaacucaaggagaagccuaccucgacaaacaauccgacacccaauacguaugcaaacgaacccuaguggaccgaggauggggcaacggcugcggacucuucggcaaaggcucccucgugacaugcgccaaauucgccugcucaaaaaaaaugaccggaaaauccauccaacccgaaaaccucgaauacaggaucaugcuaagcguccacggaucacaacacuccggaaugaucgucaacgacacaggacacgaaacagacgaaaaccgagcaaaaguagaaauaacaccaaacucccccagagccgaagccacccucggcggcuucggcucccuaggccuagacugcgaaccaagaacgggccucgacuucuccgaccucuacuaccucaccaugaacaacaaacacuggcucguacacaaagaaugguuccacgauaucccccuccccuggcacgccggcgccgacaccgggaccccccacuggaacaacaaagaagccuuagucgaauucaaagacgcacacgcaaaaagacaaaccgucgucguccucggaagccaagaaggcgcaguccacacagcccucgcgggagcccuagaagcagaaauggacggagcgaaaggccgccucuccagcggccaccucaaaugccgccucaaaauggacaaacuaagacugaaaggcgucuccuacucccucuguaccgcagcauucaccuucacaaaaauccccgcagaaacccuccacggcaccgucaccguagaaguccaauacgcaggcacggacggccccugcaaaguaccagcccaaauggccguagacaugcaaacccuaacccccgucggccgacucauaaccgcaaauccagucaucacagaaucgaccgaaaacagcaaaaugaugcucgaacuugaccccccauucggggacuccuacauaguaaucggcgucggcgaaaaaaagauaacccaccacuggcaccgcucuggaucuaccaucggcaaagccuucgaagccaccguacgcggagcaaaacgcauggccguccucggcgacaccgcaugggacuucggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7400 - RNA, 1741 nt, Artificial Sequence
  KX447515.1 solE mRNA Design 2 opt
ggggcgcugccuacggagguggcagccaucuccuucucggcaucaagcuuaccaugucacaaaaaguaaucuaccuggucaugauccuacucauagcccccgcauacagcauacgcugcauaggagucucaaaccgcgacuucgucgaaggaaugagcgggggaacguggguagacguaguccuagaacacggcggaugcguaaccguaauggcgcaagacaaaccaaccguagacauagagcuagucacaacaacagucucgaacauggcagaagucaggagcuacugcuacgaagcaaguauaagcgacauggccagcgauucccgaugcccgacacaaggagaagcauaccuagacaaacaaagcgacacacaauacguaugcaaacgcacccuaguagaccguggcuggggcaacgguugcggacuauucgggaaaggaagucuggucacaugcgcaaaauucgcaugcagcaagaaaaugaccggaaaaucgauacagcccgaaaaccuagaauaccgaauaaugcuaagcguacacgggagccaacacucgggaaugauaguaaacgacaccggacacgagaccgacgaaaacagagcaaaaguagaaauaacaccaaacucgccucgagccgaagcaacacucggaggcuucggaucacucggacucgacugcgagcccagaaccggccucgacuucucggaccuauacuaccucacaaugaacaacaaacacuggcucguacacaaagaaugguuccacgacauaccccugcccuggcacgcaggcgccgacacgggaacgccccacuggaacaacaaagaagcccuaguagaguucaaagacgcacacgccaaacgccaaaccguggucgugcucgggagccaagaaggagcagugcacacagcacuggccggagcccuggaagccgaaauggacggagcaaaaggaaggcucucaagcggacaccuaaaaugccgccugaaaauggacaaguuaaggcuaaaaggaguaucauacagccucugcacggccgcguucaccuucacaaaaauacccgcagaaacgcuacacggcaccgucacagucgaaguacaguacgcgggaaccgacggcccaugcaaaguacccgcacaaauggccguggacaugcaaacacuaacgccagugggcaggcuaauaaccgcaaacccagucauaacggaaagcacggaaaauagcaaaaugaugcucgaacucgacccaccguucggagacucguacauaguaauaggcguaggcgaaaagaaaauaacacaccacugguaccgcucgggcucaaccauaggcaaagcauucgaagcaaccgugcgaggcgccaaacgcauggcuguacucggagacacagcaugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7401 - RNA, 1741 nt, Artificial Sequence
  KU758874.1 solE mRNA Design 2 opt
ggggcgcugccuacggagguggcagccaucuccuucucggcaucaagcuuaccaugagccaaaaagucauauaccuagucaugauccuacuaaucgccccagcauacucaauacgcugcaucggcgucagcaaucgagacuucgucgaaggcaugagcggcggcacaugggucgacguaguccucgaacacggcggcugcgucaccgucauggcccaagacaaaccaaccguagacauagaacucgucacaacaacagucucaaacauggccgaagucagaagcuacugcuacgaagccuccauaagcgacauggcauccgacucacgcugcccaacacaaggcgaagcauaccucgacaaacaguccgacacgcaauacguaugcaaacgcacccuaguagacaggggcugggggaacggaugcggcuuauucggcaaaggcagccucgucacaugcgcgaaauucgccugcuccaagaaaaugaccggcaaauccauacagccagagaaccuagaauaccgaauaaugcucuccguccacggaucacaacacagcggaaugaucguaaacgacaccggccacgagaccgacgaaaaccgcgccaaagucgaaaucacccccaacagcccacgagccgaggccacacucggaggcuucggcucgcuaggacucgacugugaaccuagaaccggccucgacuucucagaccucuacuaccuaacgaugaacaacaaacacuggcuagugcacaaagaaugguuccacgacauaccacugcccuggcacgcaggcgcagacaccggcacgccacacuggaacaacaaggaagcccuaguagaguucaaagacgcccacgccaagcgacaaaccgucguagugcucggcucccaagaaggagccguccacacagcucuagccggagcacuagaagcagaaauggacggagccaaaggaaaacucucaagcggccaccuaaaaugccgacucaaaauggacaaauuacgacuaaaaggcguauccuacucccuaugcacagccgcauucacauucacaaaaauucccgccgaaacgcuacacggcacagucacaguggaaguacaauacgccggcacagacggaccaugcaaaguaccagcccaaauggccgucgacaugcaaacgcugacacccgucggcagacucauaacagccaaccccgucauaaccgaaaguaccgaaaacucaaaaaugaugcucgaacucgacccaccauucggagacagcuacauagucaucggcgucggagaaaagaaaauaacccaccacuggcaccgaagcggcuccacaaucggaaaagccuucgaagccacaguacggggagccaaacguauggccguacucggcgauaccgcaugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7402 - RNA, 1741 nt, Artificial Sequence
  KU729218.1 solE mRNA Design 2 opt
ggggcgcugccuacggagguggcagccaucuccuucucggcaucaagcuuaccaugucacaaaaagucauauaucuagucaugauccugcuaauagccccagccuacagcauccgcugcaucggaguaucgaaccgcgacuucgucgaaggcaugagcggaggcaccuggguagacguaguccuagaacacggcggaugcguuaccguaauggcacaagacaagccaaccguagacaucgagcuagucaccaccaccguuuccaacauggcagaaguacgaagcuacugcuacgaagcaaguauaagcgacauggcguccgacagccggugccccacacaaggcgaagccuaccucgacaaacaaagcgacacacaguacguuugcaagcggacgcugguggaccgcggcuggggcaacggaugcggauuguucggaaaaggaagccuagucacaugcgcgaaauucgcaugcagcaagaaaaugacaggcaaaucaauacagccagaaaaccuagaauacagaauaaugcuaagcguacacggaagucaacacagcggcaugaucgucaacgacacaggccacgagaccgacgaaaacagagcaaaaguagaaauaaccccaaacucgccaagagccgaagccacacucggaggauucggcucgcucggacucgacugcgagcccagaaccggacucgacuucuccgaccuauacuaccucacaaugaacaauaaacacugguuaguacacaaagaaugguuccacgacaucccacugcccuggcacgcaggagccgacacaggcacaccccacuggaacaacaaggaagcucuaguagaguucaaagacgcccacgcgaaacgucaaaccguaguaguacuaggcagccaagaaggcgcagugcacacagcccucgccggcgcacuagaagcggaaauggacggcgcaaaaggcagauuaagcagcggccaccuaaaaugccgccuaaagauggacaaacuaagacucaaaggaguaagcuacagccuaugcacagcagcauucaccuucaccaaaauacccgccgaaacacuacacgggacaguaacagucgaaguacaguaugcaggcacagacggccccugcaaaguacccgcacaaauggccguggacacccaaacacuaacccccguaggcaggcuaauaaccgccaacccaguaaucaccgaaagcacagaaaacagcaaaaugaugcucgaacuagaucccccauucggagacuccuacaucgucauaggagucggcgaaaagaaaaucacucaucacuggcaccgaucaggcuccaccaucggcaaagcauucgaagcaaccguacgcggcgccaaacguauggccgugcuaggcgacacagccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7403 - RNA, 1741 nt, Artificial Sequence
  KU501217.1 solE mRNA Design 2 opt
ggggcgcugccuacggagguggcagccaucuccuucucggcaucaagcuuaccaugucacaaaaagucauauacuuagucaugauacuacucauugcccccgcauacuccauacgaugcaucggcgucuccaacagagacuucguagaaggcaugagcggcggcacaugggucgacguaguccuggaacacggcggcugcguaaccgugauggcccaagacaaaccaacuguagacauagaacucgucacaaccaccguaagcaacauggccgaaauccgaagcuacugcuacgaagccagcauaagcgacauggcguccgacagccgcugcccaacccaaggcgaagccuaccuagacaaacagagcgacacacaauacgucugcaaacgcacacuaguagacagaggcuggggaaacggcugcggacuauucggaaaaggaagccuaguaacgugcgcgaaauucgccugcagcaaaaaaaugacaggaaaaucaauccagcccgagaaccuagaauacagaauuaugcuaagcguacacgggucccaacacucaggaaugauaguaaacgacacuggccacgaaaccgacgaaaacagagccaaaguagaaauaacacccaacucaccccgagccgaagccacacuaggaggcuucggcucacucggacucgacugcgaaccaagaaccggacuagacuucucggaccucuacuaccucacgaugaauaacaaacacuggcucguccacaaagaaugguuccacgacauaccccucccuuggcacgcuggcgcagacaccggaacaccacacuggaacaacaaggaagcacucgucgaauucaaagacgcccacgccaaacgccaaaccguagucguacucggaucccaagaaggggcaguacacacagcccuggccggagcacucgaagcagaaauggacggcgccaaaggacgacuaucuaguggccaccugaaaugucgccuaaaaauggacaaacuccgacucaaaggcguaagcuacagccucugcaccgcagccuucaccuucaccaaaauaccagcagaaacacuacacggcacgguaaccgucgaaguccaguacgcaggaacugacgggcccugcaaagucccagcccaaauggcagucgacaugcaaacccuuacccccguaggacgccucauaacagccaacccagucaucaccgaaagcacagaaaacagcaaaaugaugcucgaacucgacccacccuucggagacucauacauagucauuggcgugggcgaaaaaaaaauaacucaccacuggcaccgaucgggcucaacuauaggcaaagccuucgaagcgaccguccgcggcgccaaacgcauggccguacucggcgacacagccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7404 - RNA, 1741 nt, Artificial Sequence
  KU761561.1 solE mRNA Design 2 opt
ggggcgcugccuacggagguggcagccaucuccuucucggcaucaagcuuaccaugagccaaaaaguaauauaccucgucaugauccugcucauagcccccgcuuacuccauacgcugcaucggcgucagcaacagggacuucguagaaggcaugucaggcggcacauggguagacguaguccuagaacacgggggaugcgucaccguaauggcccaagacaaaccaacaguagacaucgaacucgucacgacgaccgucuccaacauggccgaaguacgcagcuacugcuacgaagcaagcauaucagacauggcauccgacucccgcugccccacccaaggcgaagccuaccucgacaaacaauccgacacccaauacguaugcaaacgaacccuaguagaccgaggcuggggaaacggcugcggacuauucggaaaaggcucacucguaacaugcgcaaaauucgccugcagcaagaaaaugaccggaaaauccauccaacccgaaaaccucgaauaccgcauaaugcucuccguccacggaagccaacacucgggcaugaucguaaacgacaccggccacgaaaccgacgaaaaccgcgcaaaaguagaaauaacacccaacagccccagagcagaagcaacccucggcggcuuuggaucccucggacuagacugcgaaccccgaaccggccucgacuucagcgaucuauacuaccucacaaugaacaacaaacacuggcuaguccacaaagaaugguuccacgacauaccucugcccuggcacgccggugcagacacaggcaccccgcacuggaacaacaaagaagcccuagucgaguucaaagacgcccacgccaaacgccaaacagucgucguccuaggcagccaagaaggcgcaguccacaccgcccuagcaggagcccuagaagcagaaauggacggagcaaaaggaagauuaucauccggccaccugaaaugucgccuaaaaauggacaaacuccgacucaaaggggucagcuacagccucugcacggccgcauucacauucacaaaaaucccagcagaaacacuccacggaaccgucacaguagaaguccaauacgcaggcaccgacggccccugcaaaguaccagcacaaauggccguagacaugcaaacccuaacccccgucggacgccuuaucaccgcaaacccaguaaucacggaaucaaccgaaaacagcaaaaugaugcuagaacucgacccgcccuucggcgacagcuacauaguuauaggcguaggagaaaagaaaauaacccaccacuggcaucgcagcgguucaaccaucggaaaagccuucgaggccaccguacgcggcgcacgccgcauggccguacucggcgacacggccugggacuucggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7405 - RNA, 1741 nt, Artificial Sequence
  KY075937.1 solE mRNA Design 2 opt
ggggcgcugccuacggagguggcagccaucuccuucucggcaucaagcuuaccaugagccaaaaaguaauauaccuagucaugauacuacucaucgcacccgccuacucaauccgcugcauaggcgucucaaaccgagacuucgucgaaggcaugagcggaggaacgugggucgacguaguacucgaacacggcggaugcgugaccguuauggcacaagacaaaccaaccgucgacauagaacucgucacaacaacggucucaaacauggccgaaguccgcucauacugcuacgaagcauccauaagcgacaugguaucugacucacgcugcccaacccagggagaagcguaccuagacaaacaaagcgacacccaauacgucugcaaaagaacccuaguggaccgcggauggggaaacggcugcggccuauucggcaaaggaagccuaguaacaugcgccaaauucgccugcagcaagaaaaugaccggcaaaucaauacagcccgaaaaccuagaauacagaauaaugcuaagcguccacggcucacaacacuccggaaugaucguaaacgacaccggacaugaaaccgacgaaaaccgagcaaaagucgaaaucaccccaaacucacccagagccgaagccacccuaggaggauucggcagccuaggccuagacugcgaaccacgaaccggacucgacuucuccgaccucuacuaccuaacaaugaacaacaaacacuggcucguccacaaagaaugguuccacgacaucccccuccccuggcacgcaggagcagacaccggcacaccccacuggaacaacaaagaagcgcucgucgaguucaaagacgcacacgccaaacgccaaaccgucgucguacuaggaagucaagaaggcgccguacacaccgcacucgcaggcgcacuagaagcagaaauggacggagccaaaggccgacucagcagcggacaccucaaaugccgacuaaaaauggacaagcuacgccucaaaggagucuccuacagccuaugcacagcagcguuuacauucacgaaaaucccagcagaaacccuccacggcacagucacggucgaaguacaauacgcaggcacagacggacccugcaaaguccccgcgcaaauggccguagacaugcaaacccugaccccaguaggccgccuuaucaccgccaacccagucaucaccgaauccacagaaaacuccaaaaugaugcucgaacuagaucccccguucggagacuccuacauaguaauaggcguaggagaaaagaaaaucacccaccacuggcacagaucgggcuccacaaucggcaaagcauucgaagcaaccguccgaggcgccaaacgcauggccguacucggagacacggcaugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7406 - RNA, 1741 nt, Artificial Sequence
  KY014317.1 solE mRNA Design 2 opt
ggggcgcugccuacggagguggcagccaucuccuucucggcaucaagcuuaccaugagccaaaaaguaauauaccucgucaugauccuucucaucgcaccagcauauuccauacgcugcauuggaguaucaaacagagacuucgucgaaggaaugagcggaggcacguggguggacgugguccuagaacacgggggcugcguaaccguaauggcucaagacaaaccgacaguagacaucgagcuagucaccaccaccgucucaaacauggcagaagucagaaguuacugcuacgaagccagcauaagcgacauggcaagcgacagcagaugccccacccaaggcgaggcauaccucgacaaacaaagcgacacccaauacguaugcaaacgcacacucguagaccgcggcuggggcaacggcugcggacuauucggcaaaggaagccucgucacaugcgccaaauucgcaugcucaaagaaaaugaccggcaaaagcauacagcccgagaaccuggaauaccgaauaaugcucagcguacacggaucacaacacucaggcaugaucgugaacgacacagggcaugaaaccgacgaaaaccgcgccaaaguagaaaucaccccgaacuccccaagagccgaagccacacucggcggcuucggcucacuaggacucgacugcgagccaagaaccggccuagacuucucagaccuuuacuaccucacaaugaauaacaaacacuggcucguccacaaagaaugguuccacgacauaccccuccccuggcacgcaggcgcagauacaggaacgccccacuggaacaacaaggaagcacuuguagaguucaaagacgcacacgccaaacgacaaaccguagucguacucggaagccaagaaggagccgugcacaccgcccuagcaggagcccucgaagccgaaauggacggagccaaaggcagacuaucaagcggacaccuaaaaugccgccuaaaaauggacaaacuacgacucaagggcguauccuacagccuaugcaccgcugcauuuaccuuuacaaaaauacccgccgaaacacuacacggcacaguaacagucgaaguccaguacgcaggcacagacgggcccugcaaaguaccagcacaaauggcaguagacaugcaaacgcuaacgcccguaggacgccucaucacagccaacccagucaucaccgaaagcauagaaaacagcaaaaugaugcuagaacuagaucccccauucggagacucauacauagucaucggcguaggagaaaagaaaaucacgcaccacuggcaccgcucaggaucaaccaucggcaaagccuuugaagcaacagugcgaggcgccaaacgcauggccguacucggagacacagccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7407 - RNA, 1741 nt, Artificial Sequence
  KU870645.1 solE mRNA Design 2 opt
ggggcgcugccuacggagguggcagccaucuccuucucggcaucaagcuuaccaugucgcaaaaaguaauauaccuagucaugauacugcucauagcaccagccuacaguauacgaugcaucggcgucagcaacagggacuucgucgaaggcaugagcggaggcacauggguugacgugguacuagaacacggcggaugcguaaccgugauggcacaagauaaaccaacgguagacaucgaacugguaacaacaacaguaagcaacauggccgaaguaaggagcuacugcuacgaagcaagcauaagcgacauggcaagcgacuccagaugcccaacacaaggcgaagccuaccucgacaaacaaagcgacacccaauacgucugcaaacgcacacucguagauagaggcuggggaaauggcugcggccuauucggaaaaggaagccucgucacgugcgcaaaauucgccugcagcaagaaaaugaccggcaaaucgauccaaccagaaaacuuagaauaucgaaucaugcugagcguacacgggagccaacacuccggaaugauagugaacgacacaggacacgaaaccgacgagaacagggcaaaaguagaaaucacaccaaacucaccccgggccgaagccacacucggaggauucggaagccucggacuagacugcgaaccaagaacaggacucgacuucagugaccuauacuaccucacaaugaacaacaaacacuggcucguacacaaagaaugguuccacgacaucccacugccauggcacgcgggcgcagacacaggcacaccccacuggaacaacaaagaagcccuaguagaguucaaagacgcacacgccaaacgccaaaccguagucguacuaggaagccaagaaggggccguacacacagcccuggccggggcacucgaagcagaaauggacggagcaaaaggcaggcucucgucaggacaucuaaaaugccgccuaaaaauggacaaacucaggcucaaaggcgugagcuacagccuguguacagcagcauucacauucacaaaaauacccgcagaaacacuccacggcacagucacgguagaaguacaauacgcaggcacagacggcccaugcaaaguacccgcgcagauggccgucgacaugcaaacacuaacacccguaggacgacuaauaaccgcaaacccggucauaaccgaaagcacggaaaauagcaaaaugaugcucgaacuagacccaccauucggcgauucauacaucgucaucggcauaggcgaaaagaaaaucacacaccacuggcaccgcucaggcucaacaauaggcaaagccuuugaagcaaccguacgcggggcaaaacgcauggcagugcuaggggacacagcaugggacuucggcagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7408 - RNA, 1741 nt, Artificial Sequence
  KU922923.1 solE mRNA Design 2 opt
ggggcgcugccuacggagguggcagccaucuccuucucggcaucaagcuuaccaugucacagaaagucaucuaccuagucaugauccuccuaaucgcacucgccuacucaauacgcugcauaggagucuccaaccgagacuucguagaaggaauguccggcggaaccuggguagacguaguccucgaacacgggggcugcguaacagucauggcccaagacaaacccaccgucgacauagaacucguaaccaccaccgucucaaacauggccgaaguccgaucguacugcuacgaagccagcaucuccgacauggccuccgacucccgaugcccaacccagggagaagccuaccuagacaaacaaagcgacacacaauacguaugcaaacgaacacucgucgaccgcggcuggggaaacgguugcggacuauucggcaaaggaagccuagucacaugcgcaaaauucgcaugcucaaagaaaaugaccggcaaauccauccaaccagaaaaccucgaauaccgaauaaugcucagcguccacggcucacaacacagcggaaugauaguaaacgacaccggacacgaaaccgacgaaaaccgcgcaaaagucgaaaucacccccaacuccccacgcgccgaagccacccuaggaggauucggaucccucggacuagacugcgaacccagaaccggccucgacuucuccgaccucuacuaccucaccaugaacaacaaacacugguuaguccacaaagaaugguuccacgacaucccccuccccuggcacgccggcgccgacacaggaaccccgcacuggaacaacaaagaagcccucgucgaguucaaagacgcgcacgccaaacgacaaaccgucgucguacuagggucccaagaaggagccguacacacagcacuagccggcgcccuugaagcagaaauggacggcgcuaaaggccgacucagcuccggacaccucaaaugcagacuuaaaauggacaaacuccgccucaaaggcgucagcuacagccucugcaccgccgcauucacauucacaaaaauacccgccgaaacccuccacggcaccgucacaguagaaguccaauacgccggaaccgacggccccugcaaaguaccagcccaaauggcagucgacaugcaaacacuaaccccagucggacgacuuaucacggcaaaccccgucaucacagaaucaaccgaaaacuccaaaaugaugcucgaacucgacccaccuuucggcgacuccuacaucguaaucggaguaggcgaaaagaaaaucacacaccacuggcaccgauccggauccacgaucggcaaagccuucgaagcaacaguccgcggagcaaaaagaauggccguacucggagauaccgccugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7409 - RNA, 1741 nt, Artificial Sequence
  KU497555.1 solE mRNA Design 2 opt
ggggcgcugccuacggagguggcagccaucuccuucucggcaucaagcuuaccaugagccaaaaagucauauaccuagucaugauccuccucauagccccagcauacuccauacgcugcaucggaguaagcaaccgagacuucgucgaaggaaugucaggcggaaccugggucgacgucguacuagaacacggcggaugcguaacaguaauggcccaagacaaaccaacaguagacaucgaacucguaacaaccacagucagcaacauggcagaaguaagauccuacugcuacgaagccucaauaagcgacauggcauccgacuccaggugcccaacacaaggcgaagccuaccucgacaaacaaagcgacacacaauacgucugcaaaagaacacuuguagacagaggauggggcaacggaugcggccucuucggaaaaggaagccucguaaccugcgccaaauucgccugcagcaaaaagaugacaggaaaaucgauccaacccgaaaaccuagaauaccgcaucaugcucuccguccacggcagccagcacucaggcaugauagucaacgacacaggacacgaaacagacgaaaaccgagccaagguagaaauaaccccaaacagcccccgagccgaagcaacccucggaggauucggaucacuaggacuagacugcgaaccccgaaccggccucgacuucuccgaccuauacuaccuaaccaugaacaacaaacacuggcucguccauaaggaaugguuccacgacauaccccugcccuggcacgcgggcgcagacacgggcacaccccacuggaacaacaaagaagcccucgucgaguucaaagacgcccacgcaaaacgccagaccguagucguacuaggcacccaagaaggagccguccacaccgcccuggccggagcccucgaagccgaaauggacggagcaaaagggcgacucagcagcggccaccuaaaaugccgccuaaaaauggacaaacuaagacuaaaaggcguaucauacagccuaugcacagcagcauucaccuucaccaaaaucccugcagaaacacuccacggcaccgucacggucgaaguccaguacgccggcacagacggacccugcaaagucccagcccaaauggccgucgacaugcaaacccuaacacccgucggaagacuaauaaccgccaaccccguaaucaccgaaagcacagaaaauucaaaaaugaugcucgaacuagaucccccguucggagacuccuacauaguuaucggcguaggcgagaaaaagaucacacaccacuggcacagauccggcagcacaauaggaaaggccuucgaagcaacaguccgcggagcaaaacgaauggcaguccucggagacacagccugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7410 - RNA, 1741 nt, Artificial Sequence
  KU312314.1 solE mRNA Design 2 opt
ggggcgcugccuacggagguggcagccaucuccuucucggcaucaagcuuaccaugucgcaaaaagucaucuaccuagucaugauccuccuaauagccccggccuacaguauacgaugcaucggcgucagcaacagggacuucgucgaaggcaugagcgggggcacguggguagacguaguuuuagaacacggcggaugcguaaccgugauggcacaagacaagccaaccguagacauagagcuagucacaaccacaguuucaaacauggcagaagucaggagcuacugcuacgaagcgagcauaagcgacauggcgagcgacagcagaugcccaacucaaggcgaagccuaccuugacaaacaaagcgacacccaguacguaugcaaaagaacccuagucgaccgaggaugggggaacgguugcggacuauucggaaaagggagccuagucacaugcgcgaaauucgccugcagcaaaaagaugacaggaaaaagcauccaacccgagaaccuagaauaucgaauaaugcucagcguacacgggagccaacacucaggaaugauagucaacgacacagggcacgaaaccgacgaaaaccgagcgaaaguggagauaacuccaaacucacccagagcugaggcaacacuaggaggcuucgggucacuuggacuagacugcgaacccagaacaggccucgacuucucggaccuauacuaccuaacaaugaacaacaaacacuggcucgugcacaaagaaugguuccacgacauaccacuaccuuggcacgcaggagcagacacagguacaccacacuggaacaacaaggaagcacucguagaguucaaagacgcacaugccaaacgacagaccguagucguacucgggagccaagaaggggccguacacacggcccuggcaggagcacuagaagcagaaauggacggagccaagggccgacucagcagcggccaccucaagugcagauugaaaauggacaagcuacgacucaaaggcguaagcuacagucuaugcaccgccgcauucacauucacaaaaaucccagcagaaacgcuacacggcacagucaccgucgaaguucaguacgccggaacagacggaccaugcaaagugcucgcccagauggcagucgacaugcaaacgcuaacgcccguagguaggcucauaaccgcgaacccgguaaucacagaaagcacagaaaacagcaaaaugaugcucgagcucgacccacccuucggagacagcuacaucgucauaggggugggagaaaagaaaaucacacaccacuggcaccgcagcgguucaaccaucggcaaagccuucgaagcgaccguacgaggagcuaaaagaauggccguacucggagacacagccugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7411 - RNA, 1741 nt, Artificial Sequence
  KY014314.1 solE mRNA Design 2 opt
ggggcgcugccuacggagguggcagccaucuccuucucggcaucaagcuuaccaugagccagaaagucaucuaccuagucaugauccugcucauagcaccagcauacagcauaagauguaucggagucuccaacagagacuucgucgaaggaaugagcggaggaaccuggguagacguagucuuagaacacgguggcugcgucaccgugauggcacaagacaaaccgacaguagacauagaacucgucacaacaacaguaagcaacauggcagaaguacgaagcuacugcuacgaagcguccauaagcgacauggccagcgacagcagaugcccaacacaaggcgaagcauaccuagacaaacaauccgacacacaguacgucugcaaacgcacccuaguagacagaggguggggcaacggaugcggacuauucgggaaagggagccuagucacaugcgccaaauucgccugcucaaagaaaaugacaggaaaaagcauacaaccagaaaaccuagaauaccgaauaaugcuaagcguacacggaagccaacacagcggcaugaucguaaacgacaccggacacgaaacagacgaaaaccgagcaaaagucgaaauaacacccaacagcccccgagccgaggccacacuaggcgguuucggaagccucggacucgacugcgaaccacgcacagggcuagacuucuccgaccucuauuaccuaacaaugaacaacaaacacuggcucguccacaaagaaugguuccacgacauaccccuacccuggcacgcaggcgcggacacaggaaccccgcacuggaacaacaaagaagcccuagucgaguucaaagaagcccacgccaaacgacagacaguagucguccuaggaagccaagaaggagccguccacacagcccuagcaggagcacucgaagcagaaauggacggggccaaaggacgccuaagcuccggacaucuaaaaugccgccuaaaaauggacaaacucagacuaaaaggagucagcuacagccuaugcacagccgccuucaccuucaccaaaauaccggcagaaacacuccacggcacagucaccgucgaaguccaauacgcaggcaccgacggaccaugcaaaguacccgcacaaauggccguagacaugcaaacacuaaccccagugggacgacucauaacugccaacccagucaucaccgaaucaaccgaaaacagcaaaaugaugcuagagcucgacccaccauucggagacagcuacauagucaucggcgucggcgagaagaaaauuacgcaucacuggcacagaagcggcucgaccauaggcaaagccuucgaagcaacaguacgcggagcaaaacgaauggccguccucggagacacagccugggacuucggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7412 - RNA, 1741 nt, Artificial Sequence
  KX447517.1 solE mRNA Design 2 opt
ggggcgcugccuacggagguggcagccaucuccuucucggcaucaagcuuaccaugucgcaaaaagucaucuaccuaguaaugauccugcuaauagcaccagccuacaguaucagaugcauaggagucucgaacagggacuucguagagggaaugucagggggcacguggguagacgugguacuagaacacggcggaugcgugaccgugauggcgcaagacaaaccgaccguagacauagaacucgucacgacaacggucucaaacauggccgaggucaggagcuacugcuacgaagcgaguauaagcgacauggcaagcgacagcagaugcccgacacagggcgaggccuaccucgacaaacagagcgacacccaauacgugugcaaacgcacccuaguggaccgaggcuggggcaacggcuguggccuguucgggaaggggagccucgucacaugcgcaaaauucgccugcagcaagaaaaugacaggaaaaagcauccagcccgaaaaccuggaauacagaauaauguuaagcgugcacggaagccagcacucaggcaugaucguaaacgacacaggccacgagaccgacgaaaaccgcgcaaaaguggaaauaaccccgaacucgccgagggcagaagccgcccuagggggauucggcucgcuagggcuagacugcgagccaagaacaggccuggacuucagcgaccuauacuaccuaacgaugaacaacaaacacuggcuagugcacaaggagugguuccacgacauacccuugcccuggcacgcgggagccgacacaggaacgccucacuggaauaacaaggaagcccuagucgaguucaaagacgcacacgcaaaacgacagaccguaguagugcuagggagccaggaaggggcagugcacacggcucuggccggagcacuggaagcggaaauggacggggccaaaggcaggcucucauccgggcaccugaaaugccgccugaagauggacaaacuaagacucaaaggcgucagcuauagccuaugcacggccgcguucacguucacgaaaauaccagccgaaacgcuacacggaacggucacgguagaaguccaguacgcgggcacggacgggccaugcaaagugccggcgcaaauggccguagacaugcaaacgcucacgccagugggaaggcuaauaaccgcgaacccaguaauaacagaaagcacagaaaauagcaagaugaugcucgagcucgaucccccguucggggacucauacauagucauaggcgugggcgagaaaaagauaacgcaccacuggcacagaucgggaucgaccauaggcaaagccuuugaagcgaccguacgcggggcaaaacgcauggcaguacucggggacacggcaugggacuuugguucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7413 - RNA, 1741 nt, Artificial Sequence
  KU729217.2 solE mRNA Design 2 opt
ggggcgcugccuacggagguggcagccaucuccuucucggcaucaagcuuaccaugucccagaaagucauauaccucguaaugauccuacuaaucgcaccagcauacagcauaagaugcauaggcguuuccaaccgagacuucguagaaggcaugagcggcggcacauggguagacgucguccucgaacacggaggaugcguaaccgucauggcccaagacaaacccacagucgacaucgaacuggucucuacaacagucuccaacauggccgaaguccgaagcuacugcuacgaagcaaccauaucggacaucgcauccgacagccgcugcccgacacaaggcgaagccuaccucgacaagcaaagcgacacacaauacgucugcaaacgaacgcucgucgaccgaggcugggguaacggcugcggccucuucggcaaagggucccucguaacaugcgccaaauucgccugcucaaagaaaaugacaggcaaauccauccaaccagaaaaccucgaauacagaaucaugcuauccguacacggcagccaacacuccggcaugauuguaaacgacacaggccacgaaaccgacgaaaaccgagcaaaaguagaaaucaccccaaacagcccccgagcagaagccacccucggcggauucggaagccucggccucgacugcgaacccagaaccggacucgacuucagcgaccucuacuaccucaccaugaauaacaaacacuggcucguacacaaagaaugguuccacgacaucccccuacccuggcacgcaggcgccgacaccggaacaccccacuggaacaacaaagaagcacucgucgaguucaaagacgcccacgccaaacgccagaccgcagucguccucggaucacaggaaggcgccguccauacagcccuagccggcgcccuagaagcagaaauggacggcgcgaaaggccgccucagcagcggccaccuaaaaugccgccucaaaauggacaaacuacgccuuaaaggcgucagcuauagccucugcacagcugcauucaccuucacaaaaauccccgcagaaacccuacacggcacagucaccgucgaaguacaauacgccggcacagauggcccaugcaaagugcccgcccaaauggccguggacaugcaaacccucaccccagucggcagacucauaaccgccaacccaguaaucaccgaaucaaccgaaaacuccaaaaugaugcucgaacucgaucccccauuuggagacuccuacauagucaucggcguaggcgaaaagaaaaucacccaccacuggcaccgcagcggauccaccauaggcaaagccuucgaagccacaguccgaggagcaaaaagaauggccgugcucggagacacagcaugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7414 - RNA, 1741 nt, Artificial Sequence
  KY328290.1 solE mRNA Design 2 opt
ggggcgcugccuacggagguggcagccaucuccuucucggcaucaagcuuaccaugucacaaaaagucauauaccuagucaugauccuacuaauagcaccagcguauagcauacgcugcaucggaguaagcaacagggacuucgucgagggcaugagcggaggcacauggguggacgucguacuggaacacggaggaugcguaacagugauggcacaagacaaaccaaccguagacauagagcuaguaacaacaacagucucgaacauggccgaagucagaucauacugcuacgaagccagcauaagcgacauggcauccgacuccaggugcccaacccagggcgaagcauaccucgacaaacaaagcgacacacaguacguaugcaaaagaacccuaguggacagaggauggggcaacggaugcggacuauucggaaaagggagccucgucacaugcgcaaaauucgccugcagcaagaaaaugacagggaaaucaauacagccagaaaaccuagaauaccgaauaaugcucagcgugcacggaagccaacacucaggcaugaucguaaacgacaccgggcacgaaacagacgaaaaccgcgcaaaagucgaaauaacaccaaacucacccagagccgaggccacacuugggggauucggcagccucgguuuagacugcgaaccaaggaccgggcucgacuucucagaccuguacuaccucacaaugaauaacaaacacuggcucguacacaaagaaugguuccaugacaucccccuacccuggcacgccggcgcagacacaggcacgccacacuggaacaacaaagaagcgcucguggaguucaaagacgcccacgccaaacgccaaaccguaguggugcuagggagccaggaaggagcagugcacacagccuuagccggcgcccuggaagcagaaauggacggagcaaaaggccggcucagcagcggacaccucaaaugccgacugaaaauggacaaacuacgccuaaaaggagugagcuacagccucugcacagccgcguucacauucagcaagauacccgcggaaacacuacacggaacaguaacagaagaaguccaauacgcaggcaccgacggacccugcaaggugcccgcacaaauggccguagacaugcaaacacucacaccgguuggcagacucaucaccgcaaaccccgugauaaccgaaagcacagaaaacucaaaaaugaugcucgaacucgacccgccauucggagacucguacauaguaauaggaguaggcgaaaagaaaaucacgcaccacuggcaccgcagcggaucaacaaucggcaaagccuucgaagcgaccgucagaggagcaaaacgcauggcgguacugggagacacagcaugggacuucggaucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7415 - RNA, 1741 nt, Artificial Sequence
  KX087101.3 solE mRNA Design 2 opt
ggggcgcugccuacggagguggcagccaucuccuucucggcaucaagcuuaccaugucccaaaaaguaauauaccuaguaaugauccuccuaauagcacccgcauacagcauccgcugcauaggggucucgaacagggacuucguagaaggcaugagcggaggaacauggguagacguagucuuagaacacggcggcugcgucaccguaauggcccaagacaaaccaaccguagacauagaacuggucaccaccacgguaucgaacauggcagaaguccgaagcuacugcuacgaagccagcaucagcgacauggccucagacagccgaugccccacccaaggcgaagccuaccucgacaaacaaucagacacccaauacguaugcaaacgcacccuaguagaccgaggcuggggcaacggcugcggccuguucggaaaagggagccuggucacaugcgccaaauucgccugcuccaagaaaaugacaggaaaaucaauccaacccgaaaaccuagaauaucgcaucaugcuauccguacacggaucccaacacuccggaaugauaguaaacgacacaggacacgaaaccgacgaaaaccgcgccaaaguagaaauaaccccaaacucucccagagccgaagccacacucggaggauucggcucccuaggccuagacugcgaaccccggaccgggcucgacuucuccgaccucuacuaccucaccaugaacaacaaacacuggcucguccauaaagaaugguuucacgacauaccccucccauggcacgcaggcgcagacaccgguacaccacacuggaacaacaaggaagcgcuaguagaguucaaagacgcccacgccaaacgccaaaccguagucgugcuaggcagccaggaaggagccguacacacagcacuggccggagcucucgaagcagaaauggacggagccaaaggccggcuaucaagcggacaccuaaaaugccgccuaaaaauggacaagcuaagacucaaaggcgugagcuacagccuaugcacagccgcauucacguucaccaaaauaccugcagaaacccuacacggaacaguaacagucgaacuccaauacgcaggcacggacggacccugcaaagugcccgcccaaauggccguggacaugcaaacgcucacacccguaggaaggcucauuacagcaaacccagucaucaccgaaagcacagaaaacucaaaaaugaugcuagaacuugaucccccauucggagacucguacauagucaucggcguaggggagaaaaagaucacacaccacuggcaccgaucaggcucaacaaucggcaaggccuucgaagccaccguccgaggagcaaaacgaauggccguacuaggggacacagccugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7416 - RNA, 1741 nt, Artificial Sequence
  KY003156.1 solE mRNA Design 2 opt
ggggcgcugccuacggagguggcagccaucuccuucucggcaucaagcuuaccaugagccaaaaagucauauaccuggucaugauccuccuaauugcaccagccuacagcauacguugcaucggcaucuccaacagagacuuugucgaaggcaugagcggagggacguggguagacgugguacuagaacacggaggcuguguaaccguaauggcccaagacaaaccaaccgucgacaucgagcuagucacuacaacagucagcaacauggcagaaguccgaagcuacugcuacgaagccagcauaagcgauauggcgagcgacagcagaugcccaacccaaggugaagcauaccuagacaaacaaagcgacacccaguacgugugcaaacgcacacugguagaccggggcuggggcaacggcugcggccuguucggcaaaggaucccuagucacaugcgcaaaauucgccugcagcaagaaaaugaccggaaaaucuauccaaccagaaaaccuagaauaucgcauaaugcuaagcguacacggaagccagcacuccggaaugaucguaaacgacaccggacacgaaaccgacgaaaaccgagccaaaguagaaaucacccccaacucgcccagagcagaagcaacccuuggaggcuucggaauccuaggacucgacugcgaacccaggaccggacuagacuucagugaccuguacuaccuaacaaugaacaacaaacacuggcucguccacaaggaaugguuccacgacauaccccucccuuggcacgcaggcgcagacacaggaacgccacacuggaacaacaaggaagcacucgucgaguucaaagacgcccacgccaaacgucaaaccgucguaguccucggcucacaagaaggagccguacacacagcccuggcaggagcccucgaagcagaaauggacggagcaaaaggacgccuaagcagcgggcaccuaaaaugccgccuaaaaauggacaaacuccgacucaaaggcguaagcuacagccuaugcaccgccgcauucaccuucacaaaaauacccgcagaaacccuccacggcaccgucaccgucgaaguccaauacgcaggaaccgacggaccaugcaaaguccccgcacaaauggcaguagacaugcaaacccucacaccaguaggaagacucaucaccgcaaacccagucaucaccgagagcaccgagaacucaaaaaugaugcucgaacucgacccacccuucggcgacucuuauauagucaucgggguaggagaaaagaaaaucacacaccacuggcaccgaucgggcuccaccauaggaaaagccuucgaagcaaccguccgcggagccaaacgcauggcugugcucggagacacggcuugggacuucggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7417 - RNA, 1741 nt, Artificial Sequence
  KU758876.1 solE mRNA Design 2 opt
ggggcgcugccuacggagguggcagccaucuccuucucggcaucaagcuuaccaugagccaaaaaguaauauaccucgucaugauacuacuaauagccccggcauacaguaucagaugcaucggggucagcaacagagacuucgucgaaggcaugaguggaggcacguggguagacguaguacuagaacacggaggaugcgucacagucauggcacaagacaaaccgaccguagacauagagcuaguaacaaccaccgucagcaacauggccgaagucagaagcuacugcuacgaagccaguauauccgacauggccagcgacucgaggugccccacccaaggcgaagccuaccuugacaaacaaagcgacacacaauacguaugcaaaagaacccuagucgaccgaggcuggggaaacggaugcggccucuucggaaagggaagccuagucacaugcgccaaauuugcaugcagcaagaaaaugacaggaaaaagcauacaacccgaaaaccuagaauaccgcaucaugcuaagcguccacggaagccagcauagcggcaugauaguaaacgacacagggcacgaaaccgacgaaaaccgagccaaaguagaaaucacaccaaacagccccagagccgaagccacgcucggaggcuucggaagccuaggacucgacugcgaacccagaaccggacucgacuucagugaccucuacuaccuaacaaugaauaacaaacacuggcugguccacaaagaaugguuccacgacaucccacuacccuggcacgcaggagcggacacgggcacaccacacuggaacaacaaagaagcucucguagaauuuaaagacgcccacgcaaaacgccagaccguagucguccuaggaagccaagaaggagccguacacaccgcccuggcaggagcgcuggaagcggaaauggacggaguaaaaggaaggcuaagcagcggccaccucaaaugccgccuaaaaauggacaaacuacgccuaaagggcguaagcuacagccuaugcacagccgcguucacauucacaaagauaccagccgaaacgcuccacgggacagucacaguagaaguccaauacgcaggaacagacggaccaugcaaagugccagcacaaauggccgucgacaugcaaacccuaacccccguaggccggcuaauaacagcaaacccugucauaaccgaaucgacagaaaacuccaagaugaugcuagaacucgaucccccauucggcgacaguuacauugucauaggagugggcgaaaagaaaauaacacaccacuggcaucgaagcggaucaaccaucggcaaagccuucgaagccaccguacgaggagccaaacgcauggcagugcuaggcgacacagcaugggacuucggcaguugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7418 - RNA, 1741 nt, Artificial Sequence
  KU926310.1 solE mRNA Design 2 opt
ggggcgcugccuacggagguggcagccaucuccuucucggcaucaagcuuaccaugagccaaaaaguaauauaccuagucaugauccuacucauagccccagcauacagcauacgcugcauaggaguguccaaccgagacuucgucgaaggcaugucaggcggcacguggguagacguaguacuagaacacggcgggugcguaacagugauggcccaagacaaacccacagucgacaucgagcucgucacaaccacagucuccaacauggccgaagucagaucauauugcuacgaagcaagcaucuccgacauggcaagcgacagcagaugcccaacccaaggagaagccuaccuugacaaacaaucagacacccaauacgucugcaaacgcacccuagucgaccggggauggggcaacggaugcgggcuauucggaaaaggaucccuaguuacaugugccaaauucgcaugcucaaagaaaaugaccgggaaaucaauacaacccgaaaaccuagaauaccgcaucaugcugagcguacacggcagccaacauucaggcaugaucguaaacgacaccggacacgaaacagaugaaaaccgcgccaaaguggaaauaacuccaaacucccccagagccgaagccacacucggaggcuucggcucgcucggacucgacugcgaacccagaacaggccuugacuucucagaccuauauuaccuuacaaugaacaacaaacacuggcucguacacaaagaaugguuccacgauauaccccuacccuggcacgcaggcgcagacaccggcacaccccacuggaacaacaaagaagcccuaguagaguucaaagacgcacacgcaaaacgccaaaccgucguaguccucggaucacaagaaggcgccguacacacggcccuugccggcgcacuagaagcagagauggacggcgccaaaggccgacuaucaagcgggcaccugaaaugcagacucaaaauggacaaacuccgacuaaagggcguguccuacucacuaugcacagcagcauucacauucacaaagauacccgcagaaacccuacacggaacgguaacagucgaaguacaauacgccggcgcagauggaccaugcaaaguacccgcgcaaauggccguagacaugcaaacacucacgcccgucggacgacucauaacugcgaaccccgucauaacagaaagcacagaaaacuccaaaaugaugcuagaacucgaucccccauucggcgacuccuauauagucaucggcgucggagagaagaaaauaacacaccacuggcaccgcuccggcuccacuaucggcaaagccuucgaagccaccguacgaggagccaaacgaauggccguccucggagacaccgcaugggacuuuggaucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7419 - RNA, 1741 nt, Artificial Sequence
  KU681081.3 solE mRNA Design 2 opt
ggggcgcugccuacggagguggcagccaucuccuucucggcaucaagcuuaccaugucccagaaagucaucuaccugguaaugauccuacuaauagcccccgcauacagcauaagaugcaucggaguauccaacagagacuucgucgaaggaauguccggcggcacauggguagacguagucuuggaacacggaggcugcguaaccgucauggcacaagacaaacccaccgucgacaucgaacucgucacgaccacagucucgaauauggccgaagucagaagcuacugcuacgaagcaagcauaagcgacauggccagcgacagcagaugcccaacccaaggcgaagccuacuuagacaaacaguccgacacccaauacguaugcaaacgcacccucguagaccgaggcuggggaaacggcugcggccuguucggaaaaggaagccucguaaccugcgcgaaauucgccugcuccaagaaaaugaccggaaaaucaauccagccugaaaaccucgaauaccgcauaaugcucagcguccacggaagccagcauagcggcaugaucguaaaugacacaggacacgaaaccgacgaaaaccgcgcaaaaguagaaauaacaccgaacucccccagggccgaggccacacucggcggcuucggcucgcucggccucgacugcgaaccaaggaccggacuagacuucagcgaccuauacuaccucacaaugaacaacaaacacuggcuaguacacaaagaaugguuccacgacauaccccucccauggcacacaggcgccgacaccggcacaccccacuggaacaacaaagaagcccuaguagaguucaaagacgcccaugccaaacgccaaaccguggucguccucggaucacaggaaggcgccguucacaccgcucuagcaggagcccuagaagccgaaauggacggagccaagggacgacucucaagcggacaccucaaaugcagacucaaaauggacaagcuacgacuaaaaggaguaagcuauagccugugcaccgcagcauucaccuucaccaaaauacccgcagaaacacuccacggcacgguaaccgucgaaguacaauacgcaggcaccgacggcccaugcaaaguacccgcccaaauggccgucgacaugcaaacacuaacccccguaggccgacucauaacagcaaacccagucauaaccgaaggcaccgaaaauagcaagaugaugcucgaacuggacccgcccuucggcgacucguacauagucauaggagugggcgagaaaaagaucacacaccacuggcaccgcuccggcucaaccauaggcaaagccuucgaagccaccguccgaggggccaaacgcauggccgugcucggagacacagccugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7420 - RNA, 1741 nt, Artificial Sequence
  KU744693.1 solE mRNA Design 2 opt
ggggcgcugccuacggagguggcagccaucuccuucucggcaucaagcuuaccaugucgcaaaaaguaauauaccucgucaugauccuccucauagcccccgccuacuccauacgcugcauaggcgucuccaaccgggacuucgucgaaggaaugagugggggcaccugggucgacguaguccuagaacacggcggaugcguaaccgcaauggcccaggacaagcccaccgucgacauagaacucguaacgacaacagucuccaacauggccgaagucagauccuacugcuacgaagcaagcaucucagacauggcaagcgacagccgaugcccaacccaaggcgaagccuaccuagacaaacaaagcgacacccaauacguaugcaaacgaacccuagucgaccgcggcuggggcaacgggugcggccuauuugggaagggaagccucgucacaugcgcaaaauuugcaugcagcaaaaagaugaccgggaaaagcauccaaccagaaaaucucgaauaccgcauaaugcuauccguccacggcagccaacacagcggcaugcuaguaaacgacaccggacacgaaaccgacgaaaaccgcgcaaaaguagaaauaacaccaaacuccccacgagcagaagcaacacucggcggcuucggaagccuaggccuagacugcgaacccagaaccggacucgacuucagcgaccucuacuaccucacaaugaacaacaaacacuggcuagcccacaaggaaugguuccacgacaucccacuacccuggcacgcaggcgcagcaacgggaacaccacacuggaacaacaaagaagcccuaguagaguucaaagacgcacaugcuaaacgacaaaccgucguaguacuaggaagccaagaaggcgcaguccacaccgcccucgccggagcacuagaagccgaaauggacggagccaaggggagacuuucaagcggccaccuaaaaugucgccuaaaaauggacaaacuacgccucaaaggcgucagcuacagccucugcacagccgcauucacauucaccaaaauaccugcugaaacagucgacggaacaguaacagucgaaggacaauacggaggaacugacggccccugcaagguaccagcacaaauggccgucgacaugcagacgcuaacgccaguaggacgacucauaaccgccaacccagucauaaccgaauccacagaaaacagcaaaaugaugcucgaacuagacccacccuucggggacuccuacauagucauaggagucggcgaaaagaaaaucacccaccacuggcaccgcagcggcucaaccauaggcaaagcauucgaagcgacaguacgcggagcaaaacgcauggccguacuaggagacacagccugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7421 - RNA, 1741 nt, Artificial Sequence
  EU545988.1 solE mRNA Design 2 opt
ggggcgcugccuacggagguggcagccaucuccuucucggcaucaagcuuaccaugucccaaaaggugauauaccuagucaugauccuccuaauagccccagccuacagcauacggugcaucggagucuccaacagagacuucgucgaaggcaugagcggaggaacauggguagacguaguccuagaacacggcggaugcguaacagugauggcgcaagacaaaccagccguagacauagaacuggucacaacaacggucagcaacauggcagaagucagaagcuacugcuacgaagcaagcauaagcgacauggcgagcgacagcagaugcccaacccagggcgaagcauaucucgacaaacaaucagacacacaguacguaugcaagagaacgcucguagaccgaggcuggggcaacggaugcggccuguucggaaaggggagccucgucacgugcgcgaaauucgcgugcagcaagaaaaugaccgggaaaucaauacagccagagaaccuggaauaccgaauaaugcucagcguccacggcagccaacacagcggcaugaucgucaacgacacaggacaugaaaccgacgaaaaucgcgcaaaagucgaaaucacaccgaacucgcccagagccgaagccacacucgggggauucgguagccuaggacucgacugcgagcccaggacaggacucgacuucucggaccuguacuaccuaacaaugaacaacaaacacuggcucgugcacaaagaaugguuccacgacauaccccuacccuggcacgcaggcgcagacacaggcacaccccacuggaacaacaaagaagcccuaguggaguucaaagacgcacaugcaaaacgacaaaccguaguagugcuaggaagccaggaaggagccguacacacagcccuggccggagcauuggaagccgaaauggacggagcaaaaggcaggcucuccagcgggcaccugaaaugccgccugaaaauggacaaacuacgacucaaaggcguguccuacagucucugcaccgcagcguucacauucacaaaaauacccgcagaaacgcuccacggcacggucacggucgaaguccaauacgcuggaaccgacggacccugcaaaguaccagcgcaaauggccguggacaugcagacgcucacaccagugggacggcucauaacagcgaacccagucauaacagaaagcacagaaaacaguaaaaugaugcucgaacuagacccgcccuucggggacuccuacauaguaaucggcguaggcgaaaagaaaauaacgcaccacuggcaccgcuccggcaguaccauaggaaaagcauucgaagcgacaguacgaggagccaagcgcauggcgguacugggagacacagccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7422 - RNA, 1741 nt, Artificial Sequence
  KY007221.1 solE mRNA Design 2 opt
ggggcgcugccuacggagguggcagccaucuccuucucggcaucaagcuuaccaugagccaaaaagucaucuaccuuguaaugauccuccuaauagccccagcguacagcauccgcugcaucggcguaaacaacagggacuucguagaaggcauguccggaggcaccuggguagacgucguacucgaacacgguggaugcguaaccguaauggcccaagacaaaccaaccguagacaucgagcuagucacgaccacaguaagcaacauggcagaagucaggagcuacugcuacgaagcaagcaucagcgacauggcaagcgacagccgcugcccaacccaaggagaagcguaccucgacaaacaaagcgacacacaauacgucugcaaaagaacccucguggaccgaggcuggggcaacggcuguggccuauucggcaaagggagccuagucacaugcgccaaauucgcaugcagcaagaaaaugaccggaaaaagcauccaacccgaaaaccuagaauaccgaauaaugcugagcguccacggaagccaacacucaggcaugaucgucaacgacaccggccacgaaacagacgaaaacagagcaaaaguagaaaucaccccaaacagccccagagccgaagcaacacuaggcggcuucggaagccugggacuggacugcgagccccgaaccggacuagacuucucagaccuauacuaccucacaaugaauaacaaacacuggcuaguacacaaagaaugguuccacgacauaccacugccauggcacgccggcgcggacaccggaacaccccacuggaacaacaaagaagcacucguagaguucaaagacgcccacgccaaacgccaaaccgucguaguacuaggcagccaagaaggagccguacacacagcccuggccggagcacucgaagccgaaauggacggggccaaaggccgacucuccagcgggcaccucaaaugccgccucaaaauggacaaacuacgacucaaaggcguaagcuacagccucugcacagccgcauucacauucaccaaaauacccgccgaaacccuacacgguacagugacagucgaaguacaauacgcaggcacggacgggcccugcaaaguacccgcacagauggccguagacaugcaaacacuaacaccagucggcagacucaucacagccaaccccguuaucaccgaaagcacagaaaacagcaaaaugaugcucgaacuagacccaccauuuggcgacagcuacauagucauuggagucggagaaaagaaaaucacacaccacuggcacagauccggcagcacaaucggaaaagccuucgaagcaaccguccgaggcgcgaaacgaauggcaguacuaggagacacagcaugggacuucgguagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7423 - RNA, 1741 nt, Artificial Sequence
  KY003152.1 solE mRNA Design 2 opt
ggggcgcugccuacggagguggcagccaucuccuucucggcaucaagcuuaccaugucccaaaaaguaauauaccuaguaaugauauuacucauagcaccggccuacagcauccgcuguauagggguauccaacagagacuucgucgagggcaugagcggcggcacaugggucgacgucguacuagagcacggcggcugcguaacagucauggcacaagacaaaccaaccguggacaucgagcuagucaccaccacagucucaaacauggccgaagucagaagcuacugcuacgaagcgagcaucagcgacauggcaagcgacagcagaugcccaacccaaggcgaggcuuaccucgacaagcagagcgacacccaauacgugugcaaacgcacgcuaguagacagaggcuggggaaauggaugcggacuuuucggaaaaggaagccuaguuacgugcgcaaaauucgccugcagcaagaaaaugaccgggaaaucaauccaacccgaaaaccuagaauaccgaauaaugcuaagcguacacggcagccaacacucgggaaugauaguaaacgacacaggacacgagacagacgaaaacagagccaaaguagaaauaacaccgaacucacccagggccgaggcaacacucggaggcuucggcucgcuagggcucgacugcgagcccagaaccggccuagacuucuccgaccuauacuaccucacaaugaauaacaaacacuggcuaguacacaaggaaugguuccacgacauaccacugcccuggcacgcaggcgcagacacaggaacaccccacuggaacaacaaggaagcccuagucgaguucaaagacgcacacgcaaagcgacaaaccguagucguccuuggaagccaagaaggagccguacacacagcccucgcaggggcccuggaagcagaaauggacggagccaaaggcagacuauccagcggacaccugaagugccgacucaaaauggacaagcucaggcucaagggagucuccuacagccuaugcgcagccgccuucacauucacaaaaauacccgcggaaacgcuccacggcacaguaacggucgaaguccaguacgcaggcacagacggacccuguaaaguacccgcgcaaauggcagucgacaugcaaacacuaacaccagucggcaggcucauaaccgccaacccggucauaaccgagaguacagaaaacagcaaaaugaugcucgaacucgaucccccauucggagacagcuacauaguaauaggaguaggcgaaaagaaaaucacccaccacuggcacagaucaggcucaacaauaggcaaagcauucgaagcaaccguacgcggagcaaaacgaauggccguccuaggggacaccgccugggacuuugguucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7424 - RNA, 1741 nt, Artificial Sequence
  KX694533.2 solE mRNA Design 2 opt
ggggcgcugccuacggagguggcagccaucuccuucucggcaucaagcuuaccaugucacaaaaaguaaucuaccucguaaugauccuacuaaucgcacccgccuacagcauacgaugcaucggaguaucaaaccgcgacuucgucgaagguauguccggcggaacauggguagacgucgucuuagaacacggagggugcguaacagucauggcccaagacaaaccaacaguagacauagagcucguaacaaccaccguaagcaacauggcagaaguccgcagcuacugcuacgaggccagcauaucagacauggccuccgacucacgaugcccaacacaaggagaagcauaccuagacaaacaaagcgacacccaauacgucugcaaaagaacacuggucgacagaggauggggcaacggaugcggccuauucggaaaaggcagccuaguaaccugcgcaaaauucgccugcagcaagaaaaugaccggcaaauccauacaaccagaaaaucuagaauaccgaauaaugcuauccguccacggaagccaacacuccggcaugaucgucaacgacaucggccacgaaaccgacgaaaaccgagccaaagucgaaaucacccccaacucaccccgagcagaagccacacucggcggcuucggaucccucggacuagacugcgaacccagaacaggccucgacuucagcgaccucuacuaccuaacaaugaacaacaaacacuggcucguccacaaagaaugguuccacgacauaccacugcccuggcacgcaggcgccgacacaggcacgccccacuggaacaacaaagaggcacucguggaguucaaagacgcccacgccaaaagacaaacaguaguaguacucggcagccaagaaggagccguccacacagcccucgcaggagcccucgaagccgaaauggacggagccaaaggcagacucuccagcgggcaccugaaaugccgccucaaaauggacaaacuacgccucaaaggcgucagcuacagccucugcacagcagccuucaccuucaccaaaauccccgccgaaacacuccacggaaccguaacaguagaaguccaauacgccggcacagacggacccugcaaaguacccgcacaaauggccgucgacaugcagacccucacgcccguaggaagacucaucaccgcaaaccccgucauaaccgaaagcacagaaaacagcaagaugaugcuagaacucgacccacccuucggagacagcuacaucguaauaggagugggagacaagaaaaucacacaucacuggcaccgcagcggcucaacaauaggcaaagcauuugaagccacaguacgcggggccaaaagaauggccguccuaggggacaccgccugggacuucggauccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7425 - RNA, 1741 nt, Artificial Sequence
  KX601167.1 solE mRNA Design 2 opt
ggggcgcugccuacggagguggcagccaucuccuucucggcaucaagcuuaccaugagucaaaaagucauauaccucgucaugauccugcuaaucgcccccgccuacagcauacgcuguaucggagugagcaacagggacuucguagaaggaaugaguggaggcaccugggucgacguaguacuagaacacggaggaugcguaaccguaauggcacaagacaaaccaaccguagacaucgagcuagucacaaccacagucucaaacauggccgaagucagaagcuacugcuacgaagcaagcaucagcgacauggcaagcgacagccgaugcccaacacaaggagaagcauaccuagacaaacaaagcgacacccaauacgugugcaaacgcacccuagucgaccgaggauggggcaauggaugcggccucuucggaaaaggaucccuagucacaugcgcgaaauucgcaugcagcaagaaaaugacuggaaaaucaauccagccagaaaaccuagaauaccgaaucaugcucucgguacacggcagucaacacagcgguaugauagugaacgacaccggacacgaaaccgaugaaaacagagccaaagucgaaauaaccccaaacucccccagagccgaagccacacuaggaggcuucggaucgcuaggacuugacugcgaaccaagaaccggacuagacuucuccgaccuauacuaucuaacaaugaacaacaaacacuggcucgugcacaaagaaugguuccacgauauaccacugccauggcacgcaggagcggacacaggaacaccccacuggaacaacaaagaagcccuaguagaguucaaagacgcccacgccaaacgacaaaccgucgucguacuaggcagccaggaaggagccguacacacagcccucgcgggcgcccuagaagccgaaauggacggagcaaaaggcagacuaucgucaggccaccucaaaugccgccugaaaauggacaaacuaaggcucaaaggagugucauacagccucugcacagccgcguucacauucacaaaaauaccagcagaaacacuccacggaacaguaacaguagaaguccaauacgcaggaacagacggacccugcaaaguccccgcccaaauggccguagacaugcaaacccucacgccagucggcagacugauaaccgcaaacccaguaaucacagaaagcacagaaaacucaaaaaugaugcucgaacuagacccaccauucggcgacagcuauauaguaauaggcgucggagacaagaaaaucacacaccacugguaccgcucaggcuccaccaucggaaaagccuucgaagccaccguacgaggagcaaaacgcauggcagugcuaggggacacggccugggacuucggaagcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7426 - RNA, 1741 nt, Artificial Sequence
  KY288905.1 solE mRNA Design 2 opt
ggggcgcugccuacggagguggcagccaucuccuucucggcaucaagcuuaccaugagccaaaaaguaauauaccuaguaaugauccuacuaauagcccccgcauacagcauccgcugcauagggguauccaacagggacuucgucgaaggcaugagcggaggcacaugggucgacgugguccuagagcacggaggcugcguaaccguaauggcacaagacaaaccaaccgucgacaucgaacuggucaccaccacaguuagcaacauggccgaagucagaagcuacugcuacgaagcaagcaucucagacauggcaagcgacucccggugccccacacaaggagaagcauaccuagacaaacagagcgacacccaauacguaugcaaacgcacacucgucgaccgaggcuggggcaacggcugcggacuauucggaaaaggaagccucgucacaugcgcaaaauucacaugcagcaaaaaaaugacaggaaagagcauccaaccagaaaaccuagaauaccgcauaaugcuaagcguacacgguagccaacacucaggcaugauagucaacgacaccggccacgaaaccgacgaaaaccgagccaaaguagaggucacccccaacagcccacgagccgaagcaacccuaggcggcuucggcagcuuaggccucgacugcgaaccccgcaccgggcuagacuucagcgaccuauacuaccuaaccaugaacaacaaacacuggcucgugcacaaagaaugguuccacgacauacccuuaccauggcacgccggcgcggacacaggcacaccccacuggaacaacaaagaagcccucgucgaauucaaagacgcucacgccaaacgccaaacaguaguaguacuaggcagccaggaaggcgcgguacacaccgcccuagccggagcccuagaagccgaaauggacggggccaaaggccgacucuucagcggacaccugaaaugccggcugaaaauggacaaacucagacuaaaaggcgucagcuacagccuaugcacagcagccuucacauuuacaaaaguacccgcagaaacacuccacggcaccgucacagucgaaguacaauacgcaggcacagacggcccaugcaaaguaccagcacaaauggccguagacaugcaaacacucacaccagugggcagacucaucaccgccaacccaguaauaaccgaaagcaccgaaaacuccaaaaugaugcuagaacucgacccaccauucggcgacuccuacauaguaauaggcgucggcgacaaaaaaaucacacaccacuggcaucgaagcggcuccacaaucggcaaagcauucgaagcaaccguaagaggagccaaacgaauggcuguacucggcgacaccgcaugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7427 - RNA, 1741 nt, Artificial Sequence
  KF268950.1 solE mRNA Design 2 opt
ggggcgcugccuacggagguggcagccaucuccuucucggcaucaagcuuaccaugucgcaaaaagucaucuaccuaguaaugauccuccucauagccccagcuuacagcaucagauguaucggaguauccaacagagacuucgucgaaggcaugagcgggggcacaugggucgacguaguccuagagcacggcgggugugucacuguaauggcgcaagacaaaccaacaguagacauagagcuaguaacaaccaccgucucaaacauggccgaaguccgaagcuacugcuaugaagccagcauaagcgacauggcaagcgacagcagaugcccgacacaaggcgaagccuaccuagacaaacaaagcgacacccaauacguaugcaaacgcacccuaguagaccggggauggggaaacggcugcggccuauucgggaaaggaagccuaguaacaugcgccaaauucacaugcagcaagaaaaugaccgggaaaucaauccaacccgaaaaccuagaauaccgcauaaugcugagcgugcacggaagccaacacucaggcaugauaguaaacgacaucggccacgaaacagacgaaaaccgagcgaaaguagaagugacaccgaacucacccagggcagaagccacgcucggaggcuucgguucguuaggacuagacugcgagcccagaacaggacucgacuuuucggaccuguacuaccuaaccaugaacaacaaacacuggcugguacacaaagaaugguuccacgacauaccccugccauggcacgcaggagcagacacuggcacaccccacuggaacaacaaagaagcacucguggaguucaaagacgcccacgccaaacgacaaaccgucgucgugcucggaagucaagaaggagcagugcacaccgcccucgccggagcacuagaagcggaaauggacggggccaaaggccgccucuucagcggacaccucaaaugcaggcugaaaauggacaaacuaagacucaagggaguaagcuacagccucugcaccgcugcauucaccuucacgaaaguacccgcggaaacgcuacacggaacaguuacggucgaaguccaguacgcaggcacggacgggcccugcaaagugcccgcacagauggccguugacaugcaaacacucaccccagucggcagacucauaacugcaaacccggucaucaccgaaaguacggaaaacagcaagaugaugcuagagcuagaucccccauucggggacuccuacauagucaucggcgugggcgacaagaaaaucacgcaccacuggcaccgaucgggcucgaccaucggcaaagccuuugaagcaaccgugcgaggagccaaacgcauggccguccucggcgacacagccugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7428 - RNA, 1741 nt, Artificial Sequence
  KF383116.1 solE mRNA Design 2 opt
ggggcgcugccuacggagguggcagccaucuccuucucggcaucaagcuuaccaugucccaaaaaguaauauaccucgucaugauacuccucauagcccccgcauacagcauacgcugcaucggggucuccaacagagacuucgucgaaggaaugagcggaggcacauggguggacguaguccuggaacacggaggaugcguaaccguaauggcccaagacaaaccaaccgucgacauagagcuaguuacaaccaccgucuccaacauggccgaaguccgcuccuacugcuacgaagccagcauaagcgacauggccagcgacagcagaugcccgacccaaggcgaagccuaccuagacaaacaaagugacacccaauacgucugcaaacgaacacucguagaucgcggcuggggcaacggcugcggucuguucggaaaaggaagccuaguaaccugcgccaaauucacaugcagcaagaaaaugaccggaaaaucaauccagcccgaaaaccucgaauaccgcauaaugcuauccguacacgguagccaacacuccggcaugaucgucaacgacaucggacacgagacagacgaaaaccgcgccaaaguagaaguaaccccaaacucccccagggccgaagcaacacucggaggcuucggaucccuaggacuagacugcgaacccagaaccggccucgauuucagcgaccuauacuaccucacgaugaacaacaaacacuggcucguacacaaagaaugguuccacgacauaccccuacccuggcacgccggcgcagacaccggcacaccccacuggaacaacaaagaagcacucguagaguucaaagacgcacacgcaaaacgccaaaccguaguaguccuaggcagccaagaaggcgccguacacaccgcccuggccggagcgcuagaagcagaaauggacggagccaaaggcagacuauucagcggccaccuaaaaugccgacuaaaaauggacaaacucagacucaaaggaguaagcuacagccuaugcaccgccguaugcaccgccgccaaaguccccgcagaaacacuacacggcacagucacaguagaaguccaauacgcaggcacggacggccccugcaaagugccagcccaaauggccguagacaugcaaacucugacaccagucggcagacucauaaccgccaacccaguaauaacagaaagcacggaaaacucaaaaaugaugcuugaacucgacccgcccuucggagacucauacauagucauaggaguaggcgacaagaaaaucacacaccacuggcaccggagcggcuccacuauaggcaaagcauucgaagcaaccguaagaggagccaaacgaauggccguacuaggggacacagcaugggacuucggcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7429 - RNA, 1723 nt, Artificial Sequence
  KU963574.2 solE mRNA Design 2 opt
ggggcgcugccuacggagguggcagccaucuccuucucggcaucaagcuuaccaugucgcaaaaagucauauaccuggucaugauccugcuuaucgcacccgcuuacuccauccgcugcaucggagucucgaacagggacuucgucgaaggcaugagcggaggcacauggguagacguaguccuagaacacggcggcugcgugaccgucauggcacaagacaaaccgacaguagacauagaacucgucacaaccacagucucgaacauggcagaaguuagaaguuacugcuacgaagccagcauaagcgacauggcaagcgacagcagaugcccaacccaaggggaagcauaccuggacaaacaaagcgacacccaauacgucugcaaacgcacgcuaguagacaggggauggggcaacggaugcggacuguucgggaaaggaagccuagucacaugcgcgaaguucacaugcagcaagaaaaugacaggaaaauccauacaacccgaaaaccuagaauaccgaauaaugcugagcgugcacggaagccaacacagcggcaugauaguaaacgacgaaaaccgcgcgaaaguagaaguaaccccaaacagcccaagggccgaggcaacgcuaggaggauucggaagccuagggcucgacugcgagcccagaaccggacucgacuucucggaccuauacuaccuaacgaugaacaacaaacacuggcuaguacacaaagaaugguuccacgacauaccgcuccccuggcacucgggagcagacaccgaaacgccacacuggaacaacaaagaagcgcuaguagaguucaaagacgcccacgccaagcgacagacaguagucguacucgggagccaggaaggagccguacacacagcccucgccggagcccucgaagcagagauggacggagccaaaggccgacuaucguccggccaccuaaaaugccgccugaaaauggacaaacucaggcuaaaaggcgugagcuacagccugugcaccgccgcauucacauucacaaaagugcccgcagaaacacuccauggaacagucacagucgaaguccaauacgcaggaagggacgggcccugcaaaguacccgcgcagauggcaguagacaugcaaacgcuaacccccgucggcagacucauaacagcgaacccggucauaaccgaaagcacagaaaacagcaaaaugaugcuagaauuagaucccccauucggggacucauacaucgucauaggcguaggcgacaagaaaauaacacaccacuggcacagaucaggcuccauaauaggcaaagccuucgaagcaacagugcgaggagccaaacgcauggcaguacuaggagacaccgccugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7430 - RNA, 1741 nt, Artificial Sequence
  KF383118.1 solE mRNA Design 2 opt
ggggcgcugccuacggagguggcagccaucuccuucucggcaucaagcuuaccaugucacaaaagguaauauaccuagucaugaucguacucauagucccggcauacagcauaagcuguaucggaguaucaaaccgagaccugguagagggcaugagcgggggcacauggguggacgugguacuggaacauggcggaugcguaaccgaaauggcgcaagacaaaccgaccguggacauagagcuaguaacaaugaccgucucgaacauggcagaagucagaagcuacugcuacgaagcaagccugagcgacauggcaagcgcaaguaggugcccgacccaaggagaaccaucacuagacaaacaaagcgacacccagagcguaugcaagagaacgcuaggggacagaggcuggggaaacggcugcggaaucuucggaaaaggaucccuagucacgugcuccaaauuuacaugcugcaagaaaaugccagggaaaagcauccagccagagaaccucgaauauagaauaaugcuacccgugcacggcagccagcacucaggaaugaucgugaacgacaucggacacgagaccgacgaaaaccgcgcaaaaguggaaguaaccccaaacucacccagagcagaagccacgcucggaggauucggaagccucgggcucgacugcgaaccccgaaccgggcucgacuucucagacuuauacuaccuaacaaugaacaacaagcacuggcucguacacaaagagugguuccacgacauaccccugccauggcacgcgggagcagacacaggcacgccgcauuggaacaacaaggaggcacucguagaguucaaagacgcgcacgcaaagcgacaaacagucguagugcucggaagccaagaaggggccguccacacagccuuagccggggcccucgaagcagaaauggacggggcaaagggccggcucuuuagcggccaccuaaaaugccgccuaaaaauggacaagcuaagacuaaagggcguaagcuacagccugugcacagccgcauucacauucacaaaaguacccgcagaaacgcuccacggcacagucacagucgagguccagagcgcgggaacggacggacccugcaaaguaccagcgcaaauggccguagacaugcaaacacucacccccgugggaaggcuaauaacagcaaacccgguaauaaccgaaagcacagaaaacagcaagaugaugcucgaguuagacccaccauucggggacucauacauaguuauaggcguaggcgacaagaaaaucacgcaccauuggcacagauccggaaguaccaucggcaaagccuucgaagcaaccgugcgcggggccaagagaauggcagugcucggagauaccgcaugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7431 - RNA, 1741 nt, Artificial Sequence
  KX520666.1 solE mRNA Design 2 opt
ggggcgcugccuacggagguggcagccaucuccuucucggcaucaagcuuaccaugcgacaaaaagucauuuaccuaguaaugauacuccuaauagccccagccuacagcauuagaugcaucgggguaucaaacagggacuucguagaaggaaugagcggcggaaccuggguagacgucguccucgaacacggcggcugcguaaccguaauggcacaagacaaaccgaccguagacauagaacucgucaccaccacagucucaaacauggcagaaguccggagcuacugcuacgaggcuucuauaagcgacauggcaagcgacagcagaugcccaacccaaggcgaagcauaccuagacaaacaaagcgacacccaguacguaugcaaaagaacccucguagaccgaggauggggcaacggcugcggccuguucggaaaaggaagccugguaacaugcgcaaaauuugccugcagcaaaaagaugacagggaaauccauccaacccgaaaaccuagaauacagaauaaugcucagcguacauggaagccaacauagcggcaugaucgucaacgacacaggacacgagacagacgaaaaccgcgcaaaaguagaaaucaccccaaacucacccagggccgaggcaacacucggcggauucggcagccucggccucgacugcgaacccagaaccggccucgacuucucagaccuguacuaucuaaccaugaacaacaaacacuggcucguccacaaagaaugguuccacgacaucccacugcccuggcacgccggcgccgacacaggaacaccacacuggaacaacaaagaagcccuagucgaguucaaagacgcacacgcaaaacgacaaacagucgucguccucggcagccaagaaggagcaguccacacggcccuggcaggagcccucgaagcagaaauggacggagccaaaggcaggcucucaucaggacaccuaaaaugccgccuuaaaauggacaaacuccgacugaaaggaguauccuacagccucugcacagccgcauucaccuucacaaaaauaccagcggaaacacugcacggcacagucaccgucgaaguccaguacgcaggcaccgacggccccugcaaaguaccagcacaaauggcgguggacaugcaaacccuaaccccaguaggccgacuaauaaccgcgaacccagucauaaccgagagcaccgaaaacaguaaaaugaugcucgagcucgacccaccauucggagacagcuacauaguaauaggcgucggugaaaagaaaaucacacaccacuggcaccgcucgggcucaaccaucggcaaagccuucgaagcaacuguacgcggagccaaacgcauggcaguacuaggagacacagcaugggacuucggcucaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7432 - RNA, 1741 nt, Artificial Sequence
  KF383120.1 solE mRNA Design 2 opt
ggggcgcugccuacggagguggcagccaucuccuucucggcaucaagcuuaccaugagccaaagagucaucuaccugguaaugauccuacuaauagccccagccuacagcauccgaugcaucggggucucgaacagagacuucgucgaaggcaugagcggaggcacauggguagacguagugcuggaacacggcggaugcguaaccguaauggcacaagacaaaccaaccguagacauagagcuagucacaacaacagucucaaacauggccgaagucaggaguuacugcuacgaagcaagcauaagcgacauggccagcgacagccgaugcccaacccaaggcgaagcauaccuagacaaacaaagcgacacccaauacgugugcaaacgcacgcuagucgacagaggauggggcaacgggugcggccucuucgggaaaggaagccuagucacgugcgcaaaauucacaugcagcaagaagaugaccggaaaaucaauccaacccgaaaaccuagaauaccgcauaaugcugagcguccacggaagccaacacucaggcaugaucgucaacgacaucggacacgagaccgacgaaaaccgagcgaaaguggaaguaaccccaaacucaccaagggccgaggccacccucggaggcuucggaucgcucgggcuagacugcgaacccagaaccggacucgacuucucagaccucuacuaccucacgaugaacaacaaacauuggcucgugcacaaagaaugguuccacgauaucccacugcccuggcacgcaggcgcggacacaggaacaccccacuggaacaauaaggaagcacuuguagaguucaaagacgcccacgccaaacgccagaccguagucguacuaggaagccaagaaggagccgugcacaccgcccuggcaggagcacuggaagcagaaauggacggagccaaaggccgacucuucagcggacacuugaaaugccgcauaaaaauggacaaacucaggcucaaaggcgugagcuacagccuaugcacugccgcauucacauucuccaagguaccagcagaaacacuccacggcaccgucacgguagaaguccaauacgcaggccgagacgggccaugcaaagugcccgcacaaauggccguagacaugcaaacgcucacacccguaggcaggcucauaacagcgaacccaaucauaacagaaaguacagaaaacagcagaaugaugcuagaacucgacccaccguucggggacuccuacauagucaucggcgugggcgacaagaaaauaacacaccacuggcauagaucgggcucaaccauaggcaaagccuucgaagcgacagugcgaggagcaaaaagaauggccguacuaggagacacagcaugggauuucggcucgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7433 - RNA, 2365 nt, Artificial Sequence
  R4803/R4833 ZIKV (strain ZikaSPH2015) Polyprotein(93-804) mRNA Design 3 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7434 - RNA, 2365 nt, Artificial Sequence
  R4815/R4837 ZIKV (isolate Z1106033) Polyprotein(93-804) mRNA Design 3 wild type
gggagaaagcuuaccaugagaauaaucaaugcuaggaaggagaagaagagacgaggcgcagauacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7435 - RNA, 2353 nt, Artificial Sequence
  R4819/R4841 ZIKV (strain MR 766) Polyprotein(93-800) mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7436 - RNA, 2365 nt, Artificial Sequence
  R4867 ZIKV (strain NatalRGN) Polyprotein(93-804) mRNA Design 3 wild type
gggagaaagcuuaccaugagaauaaucaaugcuaggaaggagaagaagagacgaggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7437 - RNA, 2290 nt, Artificial Sequence
  R4879/R5080 ZIKV (strain ZikaSPH2015) Polyprotein(108-794) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7438 - RNA, 2290 nt, Artificial Sequence
  ZIKV (isolate Z1106033) Polyprotein(108-794) mRNA Design 3 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7439 - RNA, 2278 nt, Artificial Sequence
  ZIKV (strain MR 766) Polyprotein(108-790) mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7440 - RNA, 2290 nt, Artificial Sequence
  R4869/R5114 ZIKV (strain NatalRGN) Polyprotein(108-794) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7441 - RNA, 1582 nt, Artificial Sequence
  ZIKV (strain ZikaSPH2015) Polyprotein(273-723) mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7442 - RNA, 1582 nt, Artificial Sequence
  ZIKV (isolate Z1106033) Polyprotein(273-723) mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7443 - RNA, 1570 nt, Artificial Sequence
  ZIKV (strain MR 766) Polyprotein(273-719) mRNA Design 3 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7444 - RNA, 1582 nt, Artificial Sequence
  ZIKV (strain NatalRGN) Polyprotein(273-723) mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7445 - RNA, 2290 nt, Artificial Sequence
  ZIKV (strain ZikaSPH2015) Polyprotein(108-794)(F398S) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7446 - RNA, 2290 nt, Artificial Sequence
  ZIKV (isolate Z1106033) Polyprotein(108-794)(F398S) mRNA Design 3 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7447 - RNA, 2278 nt, Artificial Sequence
  ZIKV (strain MR 766) Polyprotein(108-790)(F398S) mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuccggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7448 - RNA, 2290 nt, Artificial Sequence
  ZIKV (strain NatalRGN) Polyprotein(108-794)(F398S) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuccggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7449 - RNA, 2290 nt, Artificial Sequence
  ZIKV (strain ZikaSPH2015) Polyprotein(108-794)(N444Q) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7450 - RNA, 2290 nt, Artificial Sequence
  ZIKV (isolate Z1106033) Polyprotein(108-794)(N444Q) mRNA Design 3 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7451 - RNA, 2290 nt, Artificial Sequence
  ZIKV (strain NatalRGN) Polyprotein(108-794)(N444Q) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguucaggacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7452 - RNA, 2290 nt, Artificial Sequence
  ZIKV (strain ZikaSPH2015) Polyprotein(108-694)-Cterm-JAEV1-E(400-500) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7453 - RNA, 2290 nt, Artificial Sequence
  ZIKV (isolate Z1106033) Polyprotein(108-694)-Cterm-JAEV1-E(400-500) mRNA Design 3 wild type
gggagaaagcuuaccaugacgagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7454 - RNA, 2278 nt, Artificial Sequence
  ZIKV (strain MR 766) Polyprotein(108-690)-Cterm-JAEV1-E(400-500) mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7455 - RNA, 2290 nt, Artificial Sequence
  ZIKV (strain NatalRGN) Polyprotein(108-694)-Cterm-JAEV1-E(400-500) mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7456 - RNA, 2365 nt, Artificial Sequence; identical to SEQ ID NO: 7433
  ZIKV (strain ZikaSPH2015) Polyprotein(93-804) mRNA Design 3 wild type

SEQ ID NO: 7457 - RNA, 2362 nt, Artificial Sequence
  ZIKV prME variant mRNA Design 3 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7458 - RNA, 2359 nt, Artificial Sequence
  ZIKV prME variant mRNA Design 3 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7459 - RNA, 2356 nt, Artificial Sequence
  ZIKV prME variant mRNA Design 3 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7460 - RNA, 2353 nt, Artificial Sequence
  ZIKV prME variant mRNA Design 3 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7461 - RNA, 2350 nt, Artificial Sequence
  ZIKV prME variant mRNA Design 3 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7462 - RNA, 2347 nt, Artificial Sequence
  ZIKV prME variant mRNA Design 3 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7463 - RNA, 2344 nt, Artificial Sequence
  ZIKV prME variant mRNA Design 3 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7464 - RNA, 2341 nt, Artificial Sequence
  ZIKV prME variant mRNA Design 3 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7465 - RNA, 2338 nt, Artificial Sequence
  ZIKV prME variant mRNA Design 3 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7466 - RNA, 2335 nt, Artificial Sequence
  ZIKV prME variant mRNA Design 3 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7467 - RNA, 2332 nt, Artificial Sequence
  ZIKV prME variant mRNA Design 3 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7468 - RNA, 2329 nt, Artificial Sequence
  ZIKV prME variant mRNA Design 3 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7469 - RNA, 2326 nt, Artificial Sequence
  ZIKV prME variant mRNA Design 3 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7470 - RNA, 2323 nt, Artificial Sequence
  ZIKV prME variant mRNA Design 3 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7471 - RNA, 2320 nt, Artificial Sequence
  ZIKV prME variant mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7472 - RNA, 2320 nt, Artificial Sequence
  ZIKV prME variant mRNA Design 3 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7473 - RNA, 2332 nt, Artificial Sequence
  ZIKV prME variant mRNA Design 3 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7474 - RNA, 2356 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7475 - RNA, 2356 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7476 - RNA, 2347 nt, Artificial Sequence
  ZIKV prME variant mRNA Design 3 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7477 - RNA, 2344 nt, Artificial Sequence
  ZIKV prME variant mRNA Design 3 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7478 - RNA, 2341 nt, Artificial Sequence
  ZIKV prME variant mRNA Design 3 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7479 - RNA, 2338 nt, Artificial Sequence
  ZIKV prME variant mRNA Design 3 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7480 - RNA, 2335 nt, Artificial Sequence
  ZIKV prME variant mRNA Design 3 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7481 - RNA, 2332 nt, Artificial Sequence
  ZIKV prME variant mRNA Design 3 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7482 - RNA, 2329 nt, Artificial Sequence
  ZIKV prME variant mRNA Design 3 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7483 - RNA, 2326 nt, Artificial Sequence
  ZIKV prME variant mRNA Design 3 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7484 - RNA, 2323 nt, Artificial Sequence
  ZIKV prME variant mRNA Design 3 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7485 - RNA, 2320 nt, Artificial Sequence
  ZIKV prME variant mRNA Design 3 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7486 - RNA, 2317 nt, Artificial Sequence
  ZIKV prME variant mRNA Design 3 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7487 - RNA, 2314 nt, Artificial Sequence
  ZIKV prME variant mRNA Design 3 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7488 - RNA, 2311 nt, Artificial Sequence
  ZIKV prME variant mRNA Design 3 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7489 - RNA, 2308 nt, Artificial Sequence
  ZIKV prME variant mRNA Design 3 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7490 - RNA, 2305 nt, Artificial Sequence
  ZIKV prME variant mRNA Design 3 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7491 - RNA, 2302 nt, Artificial Sequence
  ZIKV prME variant mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7492 - RNA, 2302 nt, Artificial Sequence
  ZIKV prME variant mRNA Design 3 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7493 - RNA, 2314 nt, Artificial Sequence
  ZIKV prME variant mRNA Design 3 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7494 - RNA, 2338 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7495 - RNA, 2338 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7496 - RNA, 2338 nt, Artificial Sequence
  ZIKV prME variant mRNA Design 3 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7497 - RNA, 2335 nt, Artificial Sequence
  ZIKV prME variant mRNA Design 3 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7498 - RNA, 2332 nt, Artificial Sequence
  ZIKV prME variant mRNA Design 3 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7499 - RNA, 2329 nt, Artificial Sequence
  ZIKV prME variant mRNA Design 3 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7500 - RNA, 2326 nt, Artificial Sequence
  ZIKV prME variant mRNA Design 3 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7501 - RNA, 2323 nt, Artificial Sequence
  ZIKV prME variant mRNA Design 3 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7502 - RNA, 2320 nt, Artificial Sequence
  ZIKV prME variant mRNA Design 3 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7503 - RNA, 2317 nt, Artificial Sequence
  ZIKV prME variant mRNA Design 3 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7504 - RNA, 2314 nt, Artificial Sequence
  ZIKV prME variant mRNA Design 3 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7505 - RNA, 2311 nt, Artificial Sequence
  ZIKV prME variant mRNA Design 3 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7506 - RNA, 2308 nt, Artificial Sequence
  ZIKV prME variant mRNA Design 3 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7507 - RNA, 2305 nt, Artificial Sequence
  ZIKV prME variant mRNA Design 3 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7508 - RNA, 2302 nt, Artificial Sequence
  ZIKV prME variant mRNA Design 3 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7509 - RNA, 2299 nt, Artificial Sequence
  ZIKV prME variant mRNA Design 3 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7510 - RNA, 2296 nt, Artificial Sequence
  ZIKV prME variant mRNA Design 3 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7511 - RNA, 2293 nt, Artificial Sequence
  ZIKV prME variant mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7512 - RNA, 2293 nt, Artificial Sequence
  ZIKV prME variant mRNA Design 3 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7513 - RNA, 2305 nt, Artificial Sequence
  ZIKV prME variant mRNA Design 3 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7514 - RNA, 2329 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7515 - RNA, 2329 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7516 - RNA, 2335 nt, Artificial Sequence
  ZIKV prME variant mRNA Design 3 wild type
gggagaaagcuuaccaugagaauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7517 - RNA, 2329 nt, Artificial Sequence
  ZIKV prME variant mRNA Design 3 wild type
gggagaaagcuuaccaugaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7518 - RNA, 2332 nt, Artificial Sequence
  ZIKV prME variant mRNA Design 3 wild type
gggagaaagcuuaccaugauaaucaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7519 - RNA, 2326 nt, Artificial Sequence
  ZIKV prME variant mRNA Design 3 wild type
gggagaaagcuuaccaugaaugcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7520 - RNA, 2323 nt, Artificial Sequence
  ZIKV prME variant mRNA Design 3 wild type
gggagaaagcuuaccauggcuaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7521 - RNA, 2320 nt, Artificial Sequence
  ZIKV prME variant mRNA Design 3 wild type
gggagaaagcuuaccaugaggaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7522 - RNA, 2317 nt, Artificial Sequence
  ZIKV prME variant mRNA Design 3 wild type
gggagaaagcuuaccaugaaggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7523 - RNA, 2314 nt, Artificial Sequence
  ZIKV prME variant mRNA Design 3 wild type
gggagaaagcuuaccauggagaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7524 - RNA, 2311 nt, Artificial Sequence
  ZIKV prME variant mRNA Design 3 wild type
gggagaaagcuuaccaugaagaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7525 - RNA, 2308 nt, Artificial Sequence
  ZIKV prME variant mRNA Design 3 wild type
gggagaaagcuuaccaugaagagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7526 - RNA, 2305 nt, Artificial Sequence
  ZIKV prME variant mRNA Design 3 wild type
gggagaaagcuuaccaugagacggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7527 - RNA, 2302 nt, Artificial Sequence
  ZIKV prME variant mRNA Design 3 wild type
gggagaaagcuuaccaugcggggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7528 - RNA, 2299 nt, Artificial Sequence
  ZIKV prME variant mRNA Design 3 wild type
gggagaaagcuuaccaugggcgcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7529 - RNA, 2296 nt, Artificial Sequence
  ZIKV prME variant mRNA Design 3 wild type
gggagaaagcuuaccauggcagauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7530 - RNA, 2293 nt, Artificial Sequence
  ZIKV prME variant mRNA Design 3 wild type
gggagaaagcuuaccauggauaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7531 - RNA, 2290 nt, Artificial Sequence; identical to SEQ ID NO: 7437
  ZIKV (strain ZikaSPH2015) Polyprotein(108-794) mRNA Design 3 wild type

SEQ ID NO: 7532 - RNA, 2290 nt, Artificial Sequence
  ZIKV prME variant mRNA Design 3 wild type
gggagaaagcuuaccaugaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7533 - RNA, 2302 nt, Artificial Sequence
  ZIKV prME variant mRNA Design 3 wild type
gggagaaagcuuaccaugcggggcgcagauaccagugucggaauuguuggccuccugcugaccacagcuauggcagcggccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7534 - RNA, 2326 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacggguggagugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7535 - RNA, 2326 nt, Artificial Sequence
  ZIKV prME variant mRNA Design 3 wild type
gggagaaagcuuaccaugagaggauuguccucaaggaaacgccguucccaugauguucugacugugcaauuccuaauuuugggaaugcuguugaugacgggugccgugacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7536 - RNA, 2365 nt, Artificial Sequence
  KU321639.1 prME-long mRNA Design 3 wild type
gggagaaagcuuaccaugagaauaaucaaugcuaggaaggagaagaagagacggggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7537 - RNA, 2365 nt, Artificial Sequence
  KU312312.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7538 - RNA, 2353 nt, Artificial Sequence
  AY632535.2 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7539 - RNA, 2365 nt, Artificial Sequence
  KU527068.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7540 - RNA, 2365 nt, Artificial Sequence
  KU720415.1 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7541 - RNA, 2347 nt, Artificial Sequence
  DQ859059.1 prME-long mRNA Design 3 wild type
gggagaaagcuuaccaugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7542 - RNA, 2365 nt, Artificial Sequence
  KX377335.1 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7543 - RNA, 2365 nt, Artificial Sequence
  LC002520.1 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7544 - RNA, 2353 nt, Artificial Sequence
  KU963573.2 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7545 - RNA, 2365 nt, Artificial Sequence
  KX694534.2 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7546 - RNA, 2365 nt, Artificial Sequence
  KX447520.1 prME-long mRNA Design 3 wild type
gggagaaagcuuaccaugagaauaaucaaugcuaggaaggagaagaagagacgaggcgcagaugcuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7547 - RNA, 2365 nt, Artificial Sequence
  KX369547.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7548 - RNA, 2365 nt, Artificial Sequence
  KX447515.1 prME-long mRNA Design 3 wild type
gggagaaagcuuaccaugagaauaaucaaugcuaggaaggagaagaagagacgaggcgcagauacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7549 - RNA, 2365 nt, Artificial Sequence
  KU501217.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7550 - RNA, 2365 nt, Artificial Sequence
  KU312314.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7551 - RNA, 2365 nt, Artificial Sequence
  KX446950.2 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7552 - RNA, 2365 nt, Artificial Sequence
  KY003157.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7553 - RNA, 2365 nt, Artificial Sequence
  KX811222.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7554 - RNA, 2365 nt, Artificial Sequence
  KX447516.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7555 - RNA, 2365 nt, Artificial Sequence
  KX520666.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7556 - RNA, 2365 nt, Artificial Sequence
  KU729218.1 prME-long mRNA Design 3 wild type
gggagaaagcuuaccaugagaauaaucaaugcuaggaaggagaagaagagacgaagcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7557 - RNA, 2365 nt, Artificial Sequence
  KU761561.1 prME-long mRNA Design 3 wild type
gggagaaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7558 - RNA, 2365 nt, Artificial Sequence
  KY317938.1 prME-long mRNA Design 3 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7559 - RNA, 2365 nt, Artificial Sequence
  KY075939.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7560 - RNA, 2365 nt, Artificial Sequence
  KX806557.2 prME-long mRNA Design 3 wild type
gggagaaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7561 - RNA, 2365 nt, Artificial Sequence
  KU870645.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7562 - RNA, 2365 nt, Artificial Sequence
  KU729217.2 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7563 - RNA, 2365 nt, Artificial Sequence
  KU497555.1 prME-long mRNA Design 3 wild type
gggagaaagcuuaccaugagaauaaucaaugccaggaaggagaagaagagacgaggcgcagauacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7564 - RNA, 2365 nt, Artificial Sequence
  KX087101.3 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7565 - RNA, 2365 nt, Artificial Sequence
  KY075932.1 prME-long mRNA Design 3 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7566 - RNA, 2365 nt, Artificial Sequence
  KY014317.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7567 - RNA, 2365 nt, Artificial Sequence
  KU758876.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7568 - RNA, 2365 nt, Artificial Sequence
  KU758874.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7569 - RNA, 2365 nt, Artificial Sequence
  KY014314.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7570 - RNA, 2365 nt, Artificial Sequence
  KU926310.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7571 - RNA, 2365 nt, Artificial Sequence
  KU761560.1 prME-long mRNA Design 3 wild type
gggagaaagcuuaccaugagaauaaucaaugcugggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacguucaccaagaucccggcugaaacacugcacgggacagucacaguggagguacaguacgcagggacagauggaccuugcaagguuccagcucagauggcgguggacaugcaaacucugaccccaguugggaggcugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7572 - RNA, 2365 nt, Artificial Sequence
  KY317939.1 prME-long mRNA Design 3 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7573 - RNA, 2365 nt, Artificial Sequence
  KY075937.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7574 - RNA, 2365 nt, Artificial Sequence
  LC191864.1 prME-long mRNA Design 3 wild type
gggagaaagcuuaccaugagaauaaucaaugcuaggaaggagaagaagagacgaggcgcagauacuaaugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7575 - RNA, 2365 nt, Artificial Sequence
  KX447517.1 prME-long mRNA Design 3 wild type
gggagaaagcuuaccaugagaauaaucaaugccaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7576 - RNA, 2365 nt, Artificial Sequence
  KU922923.1 prME-long mRNA Design 3 wild type
gggagaaagcuuaccaugagaauaaucaaugcuaggaaggagaagaagagacgaggcgcagaaacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7577 - RNA, 2365 nt, Artificial Sequence
  KY003156.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7578 - RNA, 2365 nt, Artificial Sequence
  KU312313.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7579 - RNA, 2365 nt, Artificial Sequence
  KY075935.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7580 - RNA, 2365 nt, Artificial Sequence
  KY014320.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7581 - RNA, 2365 nt, Artificial Sequence
  KX827309.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7582 - RNA, 2365 nt, Artificial Sequence
  KU681081.3 prME-long mRNA Design 3 wild type
gggagaaagcuuaccaugagaauaaucaaugcuaggaaggagaagaagagacgaggcacagauacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7583 - RNA, 2365 nt, Artificial Sequence
  KU744693.1 prME-long mRNA Design 3 wild type
gggagaaagcuuaccaugagaauaaucaaugcuaggaaggagaagaagagacgaggcgcagauacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucaggugguguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7584 - RNA, 2365 nt, Artificial Sequence
  KY328290.1 prME-long mRNA Design 3 wild type
gggagaaagcuuaccaugagaauaaucaaugcuaggaaggagaagaagagacgaggcacagauacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7585 - RNA, 2365 nt, Artificial Sequence
  KX694532.2 prME-long mRNA Design 3 wild type
gggagaaagcuuaccaugagaauaaucaaugccaggaaggagaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuagcagcagcugccaucgcuuggcucuugggaagcucaacgagccaaaaagucauauacuuggucaugauacugcugauugcuccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggcgaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaauucaaggaugcacaugccaaaaggcaaacugucgugguucuagggagucaagagggagcaguucacacggcccuugcuggagcucuggaggcugagauggauggugcaaagggaaggcuguccucuggccacuugaaaugucgccugaaaauggauaaacuuagauugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7586 - RNA, 2365 nt, Artificial Sequence
  KU955593.1 prME-long mRNA Design 3 wild type
gggagaaagcuuaccaugagaauaaucaaugcuaggaaggagaagaagagacgaggcacagauacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7587 - RNA, 2365 nt, Artificial Sequence
  KY272987.1 prME-long mRNA Design 3 wild type
gggagaaagcuuaccaugagaauaaucaaugcuaggaaggaaaagaagagacgaggcacagacacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7588 - RNA, 2365 nt, Artificial Sequence
  EU545988.1 prME-long mRNA Design 3 wild type
gggagaaagcuuaccaugagaauaaucaaugcuaggaaggagaagaagagacgaggcacagauacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7589 - RNA, 2365 nt, Artificial Sequence
  KU681082.3 prME-long mRNA Design 3 wild type
gggagaaagcuuaccaugagaauaaucaaugcuaggaaggagaagaagagacgaggcgcagauacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcugauguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7590 - RNA, 2365 nt, Artificial Sequence
  KX601167.1 prME-long mRNA Design 3 wild type
gggagaaagcuuaccaugagaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7591 - RNA, 2365 nt, Artificial Sequence
  KX694533.2 prME-long mRNA Design 3 wild type
gggagaaagcuuaccaugagaauaaucaaugcuaggaaggagaagaagagacguggcgcagacaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcugaugugggguguucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7592 - RNA, 2365 nt, Artificial Sequence
  KY288905.1 prME-long mRNA Design 3 wild type
gggagaaagcuuaccaugagaauaaucaaugcuaggaaggagaggaagagacguggcgcagacaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcugacguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7593 - RNA, 2365 nt, Artificial Sequence
  KF268950.1 prME-long mRNA Design 3 wild type
gggagaaagcuuaccaugagaauaaucaaugcuaggaaggagaggaagagacguggugcagacaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7594 - RNA, 2365 nt, Artificial Sequence
  KF383121.1 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7595 - RNA, 2347 nt, Artificial Sequence
  KF268949.1 prME-long mRNA Design 3 wild type
gggagaaagcuuaccaugagaauaaucaaugcuaggaaggagaggaagagacguggugcagacaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcugacguggggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7596 - RNA, 2365 nt, Artificial Sequence
  KU955595.1 prME-long mRNA Design 3 wild type
gggagaaagcuuaccaugagaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7597 - RNA, 2365 nt, Artificial Sequence
  KF383116.1 prME-long mRNA Design 3 wild type
gggagaaagcuuaccaugagaauuaucaaugcuaggaaggagaggaagagacguggcgcugacaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcugauguugggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7598 - RNA, 2347 nt, Artificial Sequence
  KU963574.2 prME-long mRNA Design 3 wild type
gggagaaagcuuaccaugagaauaaucaaugcuaggaaggagaggaagagacguggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcugaugugggguguucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7599 - RNA, 2347 nt, Artificial Sequence
  KX601166.1 prME-long mRNA Design 3 wild type
gggagaaagcuuaccaugagaauuaucaaugcuaggaaggagaggaagagacguggcgcugacaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcugauguugggugcucgguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7600 - RNA, 2365 nt, Artificial Sequence
  KF383118.1 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcugacguggggugcucaguggacuucucaaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7601 - RNA, 2359 nt, Artificial Sequence
  KF383120.1 prME-long mRNA Design 3 wild type
gggagaaagcuuaccaugagaauaaucaaugcuaggaaagagaggaagagacguggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcagacguggggugcucaguugacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7602 - RNA, 2290 nt, Artificial Sequence
  KU321639.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7603 - RNA, 2290 nt, Artificial Sequence
  KU312312.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7604 - RNA, 2278 nt, Artificial Sequence
  AY632535.2 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7605 - RNA, 2290 nt, Artificial Sequence
  KU527068.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7606 - RNA, 2290 nt, Artificial Sequence
  KX421193.1 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7607 - RNA, 2290 nt, Artificial Sequence
  KX377335.1 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucgcaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggucuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7608 - RNA, 2290 nt, Artificial Sequence
  LC002520.1 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7609 - RNA, 2272 nt, Artificial Sequence
  DQ859059.1 prME-short mRNA Design 3 wild type
gggagaaagcuuaccaugaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7610 - RNA, 2278 nt, Artificial Sequence
  KU963573.2 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7611 - RNA, 2290 nt, Artificial Sequence
  KX694534.2 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaggggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7612 - RNA, 2290 nt, Artificial Sequence
  KX369547.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuagaaagcugcaaacgcggucgcaaaccugguuggaaucaagagaauacacaaagcacuugauuagagucgaaaauuggauauucaggaacccuggccucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7613 - RNA, 2290 nt, Artificial Sequence
  KX447515.1 prME-short mRNA Design 3 wild type
gggagaaagcuuaccaugacuagugucggaauuguuggccuccuacugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7614 - RNA, 2290 nt, Artificial Sequence
  KU729218.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccacuaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7615 - RNA, 2290 nt, Artificial Sequence
  KU501217.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcugcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7616 - RNA, 2290 nt, Artificial Sequence
  KU312314.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7617 - RNA, 2290 nt, Artificial Sequence
  KX446950.2 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuacgcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccagcauacagcaucaggugcauaggagucagcaauagggacuuuguggaagguaugucaggugggacuuggguugauguugucuuggaacauggagguugugucaccguaauggcacaggacaaaccgacugucgacauagagcuggucacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7618 - RNA, 2290 nt, Artificial Sequence
  KY003157.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagucgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7619 - RNA, 2290 nt, Artificial Sequence
  KX811222.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucagcuuggguuguguacggaaccugccaucacaaaaaaggugaagcacggagaucuagaagagcugugacgcuccccucccauuccacuaggaagcugcaaacgcggccgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7620 - RNA, 2290 nt, Artificial Sequence
  KX447516.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaaguucaacgagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7621 - RNA, 2290 nt, Artificial Sequence
  KX520666.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7622 - RNA, 2290 nt, Artificial Sequence
  KU497555.1 prME-short mRNA Design 3 wild type
gggagaaagcuuaccaugacuagugucggaaucguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7623 - RNA, 2290 nt, Artificial Sequence
  KY075939.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcauuugauuagagucgaaaauuggauauucaggaacccuggcuucgcguuagcagcagcugccaucgcuuggcuuuugggaagcucaacaagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7624 - RNA, 2290 nt, Artificial Sequence
  KY075932.1 prME-short mRNA Design 3 wild type
gggagaaagcuuaccaugacuagugucggaauuguuggccuccugcugaccacagcuauggcagcggaggucacuagacgugggagugcauacuauauguacuuggauagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagaaucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugauaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7625 - RNA, 2290 nt, Artificial Sequence
  KU870645.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugagugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauacucaggaacccuggcuucgcguuagcagcagcugccaucgcuuggcuuuugggaagcucaacgagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7626 - RNA, 2290 nt, Artificial Sequence
  KU729217.2 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7627 - RNA, 2290 nt, Artificial Sequence
  KX087101.3 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccaccaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7628 - RNA, 2290 nt, Artificial Sequence
  KY014317.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcgcuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucucaacucauugggcaagggcauccaucaaauuuuuggagcagcuuucaaaucauuguuuggaggaauguccugguucucacaaauucucaucggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7629 - RNA, 2290 nt, Artificial Sequence
  KU758876.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuuccuuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7630 - RNA, 2290 nt, Artificial Sequence
  KU758874.1 prME-short mRNA Design 3 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgccuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7631 - RNA, 2290 nt, Artificial Sequence
  KY317939.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaaagaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcauaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7632 - RNA, 2290 nt, Artificial Sequence
  KY014314.1 prME-short mRNA Design 3 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7633 - RNA, 2290 nt, Artificial Sequence
  KX447517.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugcgaugccaccaugagcuaugaaugcccuaugcuggaugaggggguggaaccagaugacgucgauuguuggugcaauacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaacucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7634 - RNA, 2290 nt, Artificial Sequence
  KU926310.1 prME-short mRNA Design 3 wild type
gggagaaagcuuaccaugacuagugucggaauuguuggccuccugcugaccacagcuauggcagcggaggucaccagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7635 - RNA, 2290 nt, Artificial Sequence
  KU922923.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagccgugacgcuccccucccauuccacuaggaagcugcaaacgcggucgcaaaccugguuggaaucaagagaauacacaaagcacuugauuagagucgaaaauuggauauucaggaacccugguuucgcuuuagcagcagcugccaucgcguggcuuuugggaagcucaacgagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7636 - RNA, 2290 nt, Artificial Sequence
  KY075937.1 prME-short mRNA Design 3 wild type
gggagaaagcuuaccaugacuagugucggaauuguuggccuccugcugaccacagcuauggcagcagaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggagugcugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7637 - RNA, 2290 nt, Artificial Sequence
  KY003156.1 prME-short mRNA Design 3 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccauagcuuggcuuuugggaagcucaacgagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7638 - RNA, 2290 nt, Artificial Sequence
  KU312313.1 prME-short mRNA Design 3 wild type
gggagaaagcuuaccaugacuagugucggaauuguuggccuccugcugaccacagcuauggcagcggaagucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccauuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcaugggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7639 - RNA, 2290 nt, Artificial Sequence
  KY075935.1 prME-short mRNA Design 3 wild type
gggagaaagcuuaccaugacuagugucggaauuguuggccuccugcugaccacagcuauggcagcggaggucacuagacgugggagugcauacuacauguacuuggacagaaacgaugcuggggaggccauaucuuucccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacagagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaaguuauauacuuggucaugauacugcugauugccccggcauacagcaucaggugcauaggagucagcaauagggacuuuguggaagguaugucaggugggacuuggguugauguugucuuggaacauggaggcugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacccaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagauacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccucaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7640 - RNA, 2290 nt, Artificial Sequence
  KY014320.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugccggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaagcgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacuguugacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagcuuggugacaugcgcuaaguuugcaugcuccaagaagaugaccgggaagagcauccagccagagaauuuggaguaccggauaaugcugucaguucauggcucccagcacagugggaugaucguuaaugacacaggacaugaaacugaugagaacagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaagagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggugcucuuaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7641 - RNA, 2290 nt, Artificial Sequence
  KY328290.1 prME-short mRNA Design 3 wild type
gggagaaagcuuaccaugacuagugucggaauuguuggccuccugcugaccacagccauggcagcggaagucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7642 - RNA, 2290 nt, Artificial Sequence
  KU681081.3 prME-short mRNA Design 3 wild type
gggagaaagcuuaccaugacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagauccagaagagcugugacgcuccccucccauuccacuaggaagcugcaaacgcggucgcagaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcguucuuaacucauugggcaagggcauccaucaaauuuuuggagcagcuuucaaaucauuguuuggaggaauguccugguucucacaaauucucauuggaacguugcugaugugguugggucugaauacaaagaauggaucuauuucccuuaugugcuuggccuuagggggaguguugaucuucuuauccacagccgucuccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7643 - RNA, 2290 nt, Artificial Sequence
  KX827309.1 prME-short mRNA Design 3 wild type
gggagaaagcuuaccaugacuagugucggaauuguuggccuccugcugaccacagcuauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcagaccugguuggagucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagauacccaauaugucugcaaaagaacguuaguggacagaggcuggggaaauggauguggacuuuuuggaaaagggagccuggugacaugcgcuaaguuugcaugcuccaagaaaaugaccgggaagagcauccagccagagaaucuggaguaccggauaaugcugucaguccauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggacaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcaguaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggccugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7644 - RNA, 2290 nt, Artificial Sequence
  KU955593.1 prME-short mRNA Design 3 wild type
gggagaaagcuuaccaugacuagugucggaauuguuggccuccugcugaccacagccauggcaguggaggucacuagacgugggaaugcauacuauauguacuuggacagaagcgaugcuggggaggccauaucuuuuccaaccacaauggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcacggagaucuagaagagcugugacgcuccccucccauuccacuaggaagcugcaaacgcggucgcagaccugguuggaaucaagagaauacacaaagcaccugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcuugcucuaagaaaaugaccgggaagagcauccagccagagaaucuggaguaccggauaaugcugucaguucauggcucccagcacagugggaugaucguuaaugauacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacacuggaacaacaaagaagcacugguagaguucaaggacgcacaugccaaaaggcagacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacuccaagaugaugcuggaacuggauccaccauuuggggacucuuacauugucauaggagucggggaaaagaagaucacccaccacuggcacaggaguggcagcaccauuggaaaagcauuugaagccacugugagaggugccaagagaauggcagucuugggagacacagccugggacuuuggaucaguugggggugcucucaacucacugggcaagggcauccaucaaauuuuuggagcagcuuucaaaucauuguuuggaggaauguccugguucucacaaauucucauuggaacguugcuggugugguugggucugaauacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7645 - RNA, 2290 nt, Artificial Sequence
  KY272987.1 prME-short mRNA Design 3 wild type
gggagaaagcuuaccaugacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucagcaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7646 - RNA, 2290 nt, Artificial Sequence
  KY007221.1 prME-short mRNA Design 3 wild type
gggagaaagcuuaccaugacuagugucggaauuguuggccuccugcugaccacagccauggcagcggaggucacuagacgugggagugcauacuauauguacuuggacagaagcgaugcuggggaggccauaucuuuuccaaccacacuggggaugaauaaguguuauauacagaucauggaucuuggacacaugugugaugccaccaugagcuaugaaugcccuaugcuggaugaggggguagaaccagaugacgucgauuguuggugcaacacgacgucaacuuggguuguguacggaaccugccaccacaaaaaaggugaagcgcggagaucuagaagagcugugacgcuccccucccacuccacuaggaagcugcaaacgcggucgcagaccugguuggaaucaagagaauacacaaagcacuugauuagagucgaaaauuggauauucaggaacccuggcuucgcguuggcagcagcugccaucgcuuggcuuuugggaagcucaacgagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaaggguauccaucaaauuuuuggagcagcuuucaaaucauuguuuggaggaauguccugguucucacaaauucucauuggaacguugcugaugugguugggucugaauacaaagaauggaucuauuucccuugugugcuuggccuuagggggaguguugaucuucuuguccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7647 - RNA, 2290 nt, Artificial Sequence
  EU545988.1 prME-short mRNA Design 3 wild type
gggagaaagcuuaccaugacuagugucggaauuguuggccuccugcugaccacagccauggcaguggaggucacuagacgugggagugcauacuauauguacuuggacagaagcgaugcuggggaggccauaucuuuuccaaccacacuggggaugaacaaguguuacauacagaucauggaucuuggacacaugugugaugccaccaugagcuaugaaugcccuauguuggaugaggggguagaaccagaugacgucgauuguuggugcaacacgacaucaacuuggguuguguacggaaccugccaccacaaaaaaggugaagcacggagaucuagaagagcugugacgcuccccucccauuccacuaggaagcugcaaacgcggucgcagaccugguuggaaucaagagaauauacaaagcaccugauuagagucgaaaauuggauauucaggaacccuggcuucgcguuagcagcagcugccaucgccuggcuuuugggaaguucaacgagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaguuggaggugcucucaacucauugggcaagggcauccaucaaauuuuuggagcagcuuucaaaucauuguuuggaggaauguccugguucucacaaauucucauuggaacguugcuggugugguugggucugaauacaaagaauggaucuauuucccuuacgugcuuggccuuagggggaguguugaucuuuuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7648 - RNA, 2290 nt, Artificial Sequence
  KU681082.3 prME-short mRNA Design 3 wild type
gggagaaagcuuaccaugacuagcgucggaauuguuggccuccuccugaccacagccauggcaguagaggucacuagacgugggagugcauacuauauguacuuggacagaagcgaugcuggggaggccauaucuuuuccaaccacacuggggaugaauaaguguuacauacaaaucauggaucuuggacacaugugugaugccaccaugagcuaugaaugcccuauguuggaugaggggguagaaccagaugacgucgauugcuggugcaacacgacaucaacuuggguuguguauggaaccugccaccacaaaaaaggugaagcacggagaucuagaagagcugugacgcuccccucccauuccacuaggaagcugcaaacgcggucgcagaccugguuggaaucaagagaauacacaaagcaccugauuagaguugaaaauuggauauucaggaacccuggcuucgcguuagcagcagcugucaucgcuuggcuuuugggaaguucaacgagccaaaaagucauauaucuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccgacugucgacauagagcugguuacaacaacagucagcaacauggcggagguaagauccuacugcuaugaggcaucaauaucggauauggcuucggacagccgcugcccaacacaaggugaggccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuugggagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugcaaaaaggcaaacugucgugguucuagggagucaagaaggagcaguucacacggcccuugcuggagcucuggaggcugagauggauggagccaagggaaggcuguccucuggccacuugaaaugucgccugaaaauggauaaacuuagauugaagggcgugucauacuccuugugcacugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggacuuuggaucaguugggggugcucucaacucauugggcaagggcauccaucaaauuuuuggagcagcuuucaaaucauuguucggaggaauguccugguucucacaaauucucauuggaacguugcuggugugguugggucugaauacaaagaauggaucuauuucccuuacgugcuuggccuuagggggaguguugaucuucuuauccacagccguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7649 - RNA, 2290 nt, Artificial Sequence
  KX601167.1 prME-short mRNA Design 3 wild type
gggagaaagcuuaccaugaccagugucggaauuguuggccuccugcugaccacagccauggcaguggaggucaccagacgugggagugcauacuauauguacuuagacagaagcgaugcuggggaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7650 - RNA, 2290 nt, Artificial Sequence
  KX694533.2 prME-short mRNA Design 3 wild type
gggagaaagcuuaccaugaccagugucggaauuguuggccuccugcugaccacagccauggcaguggaggucaccagacgugggagugcauacuauauguacuuagacagaagcgaugcugggaaggccauaucuuuuccaaccacacugggggugaauaaguguuacauacagaucauggaucuuggacacaugugugaugccacaaugagcuaugaaugcccuauguuggaugaggggguagaaccagaugacgucgauugcuggugcaacacgacaucgacuuggguuguguacggaaccugccaucacaaaaaaggugaggcacggagaucuagaagagcugugacgcuccccucucauuccacuaggaagcugcaaacgcggucgcagaccugguuggaaucaagagaauacacaaagcacuugaucagagucgaaaauuggauauucaggaacccuggcuuugcguuggcagcagcugccauugcuuggcuuuugggaagcucaacgagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucagucggaggugcucucaacucauugggcaagggcauccaucaaauuuuuggagcagcuuucaaaucauuguuuggaggaauguccugguucucacaaauccucauaggaacguugcuggugugguugggucugaacacaaagaauggaucuauuucccuuacgugcuuggccuuagggggaguguugaucuuccuaucuacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7651 - RNA, 2290 nt, Artificial Sequence
  KY288905.1 prME-short mRNA Design 3 wild type
gggagaaagcuuaccaugaccagcaucggaaucguuggccuccuguugacuacagccauggcagcagagaucacuagacgugggagugcauacuacauguacuuggauaggagcgaugcagggaaggccauuucuuucgcuaccacauugggggugaacaaaugccaugugcagaucauggaccucgggcacaugugugacgccaccaugagcuaugaaugcccuaugcuggacgaggggguggaaccagaugacgucgauugcuggugcaacacgacaucaacuuggguuguguacggaaccugucaucauaaaaaaggugaagcacggcgaucuagaagagccgucacgcucccaucucacuccacaaggaaauugcaaacgcggucgcagacuuggcuagaaucaagagaauacacaaagcaccugaucaagguugaaaauuggauauucaggaacccugguuuuacgcuaguggcugucgccaucgccuggcuuuugggaagcucgacgagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucagucggagguguguuuaacucauugggcaagggcauucaucagauuuuuggagcagcuuucaaaucacuguuuggaggaauguccugguucucacagauccucauaggcacucugcuggugugguuaggucugaacacaaagaaugggucuaucucccucacaugcuuagcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7652 - RNA, 2290 nt, Artificial Sequence
  KF268950.1 prME-short mRNA Design 3 wild type
gggagaaagcuuaccaugaccagcaucggaaucauuggucuccugcugacuacagccauggcagcggagauuaccagacguggaagugcauacuacauguacuuggacaggagcgaugcugggaaggccaucuccuuugcuaccaacuugggaguuaacaaaugccauguacagaucauggaucucgggcacaugugugacgccaccaugaguuaugagugcccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaaguugcaaacgcggucgcagaccugguuagaaucaagagaauacacgaagcaccugaucaagguugaaaacuggauauuuaggaaccccggguuugcgcucgcagcuguugccauugccuggcuuuugggaagcucgacgagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucagucgggggcguguucaacucauugggcaaggguguucaccagauuuuuggagcagcuuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7653 - RNA, 2290 nt, Artificial Sequence
  KF383121.1 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaaugguuguggacuuuuuggcaaagggagcuuggugacaugugccaaguucacguguucuaagaagaugaccgggaagagcauucaaccggaaaaucuggaguaucggauaaugcuaucagugcauggcucccagcauagcgggaugauugucaaugauauaggacaugaaacugacgaaaacagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7654 - RNA, 2272 nt, Artificial Sequence
  KF268949.1 prME-short mRNA Design 3 wild type
gggagaaagcuuaccaugaccagcaucggaaucauuggucuccugcugacuacagccauggcagcagagauuaccagacguggaagugcauacuacauguacuuggacaggagcgaugcugggaaggccaucuccuuugcuaccaauuugggaguuaacaaaugccauguacagaucauggaucucgggcacaugugugacgccaccaugaguuaugaguguccuauguuggacgagggaguggaaccagaugaugucgauugcuggugcaacacgacaucaacuuggguuguguacggaaccugucaucacaaaaaaggugaagcacggcgaucuagaagagcugugacgcucccuucucacucuacaaggaagcugcaaacgcggucgcagacuugguuagaaucaagagaauacacgaagcacuugaucaagguugaaaacuggauauucaggaaccccggguuugcgcucgcagcuguugccauugccuggcuuuugggaagcucgacgagccaaaaagucauauacuuggucaugauacugcugauugccccggcauacagcaucaggugcauuggagucagcaauagagacuucguggaaggcaugucaggugggaccuggguugaugucgucuuggaacauggagguugcgucaccguaauggcacaggacaagccaacaguugacauagaguuggucacgacaacggucaguaacauggccgagguaagauccuacuguuaugaggcaucaauaucggacauggcuucggacagucgcugcccaacacaaggugaagccuaccuugacaagcaaucagacacucaauauguaugcaaaagaacauugguggacagagguuggggaaauggguguggacuuuuuggcaaagggagccuggugacaugugccaaguucacguguuccaagaagaugaccgggaagagcauucagccggagaaucuggaguaucgaauaaugcuaucagugcauggcucccagcacagcgggaugauuguuaaugacgaaaauagggcgaaagucgaggucacgcccaauucaccaagagcagaagcaaccuugggaggcuuuggaagcuuaggacuugauugugaaccaaggacaggccuggacuuuucagauuuguacuacuugaccaugaacaauaagcacugguuagugcacaaagagugguuucaugacaucccauugcccuggcaugcuggggcagacaccggaacuccacauuggaacaacaaggaggcauugguagaguucaaagaugcccacgcuaagaggcaaaccgucguuguucuagggagccaggaaggagccguucacacggcucuugcuggagcucuggaggcugagauggauggugcaaaaggaagguuguucuccggccauuugaaaugccgcuuaaaaauggacaagcuuagauugaagggcgugucauauuccuugugcaccgcagcguucacauucaccaaggucccagcugaaacauugcauggaacaguuacaguggaggugcaguaugcagggacagauggacccugcaaggucccagcucagauggcgguggacaugcagacccugaccccagucggaaggcugauaaccgccaaccccgugauuacugaaagcacugagaauucaaagaugauguuggagcucgacccaccauuuggggauucuuacauugucauaggaguuggggacaagaaaauuacccaccacuggcauaggagugguagcaccaucggaaaagcauuugaggccacugugagaggugccaagagaauggcaguucugggggacacagccugggacuuuggaucagucgggggcguguuuaacucauugggcaagggcauccaccagauuuuuggagcagccuucaaaucacuguuuggaggaauguccugguucucacagauccucauaggcacgcugcuggugugguuggguuugaacacaaagaauggauccaucucccucacaugcuuggcccuggggggagugaugaucuuccucuccacggcugucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7655 - RNA, 2290 nt, Artificial Sequence
  KU955595.1 prME-short mRNA Design 3 wild type
gggagaaagcuuaccaugaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacacaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuacuugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7656 - RNA, 2290 nt, Artificial Sequence
  KF383116.1 prME-short mRNA Design 3 wild type
gggagaaagcuuaccaugaccagcaucggaaucgucggccuccugcugaccacagccauggcagccgagaucaccagacgugggagugcauacuacauguacuuggacaggagcgaugcugguaaggccauuucuuuugcuaccacauugggggugaacaaaugccauguacagaucauggaccucgggcacaugugugacgccaccaugaguuaugagugccccaugcuggacgagggaguggagccagaugacgucgauugcuggugcaacacgacaucaacuuggguuguguacggaaccugucaacauaaaaaaggugaagcacgacgauccagaagagccgugacgcuuccuucucacuccacaaggaagcugcaaacgcgaucacagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuuuaaaucacuguuuggaggaauguccugguucucacagauccucauaggcacacuguuggugugguuaggucugaacacaaagaauggaucuaucucccucacaugcuuagcccuggggggagugaugaucuuccuuuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7657 - RNA, 2272 nt, Artificial Sequence
  KX601166.1 prME-short mRNA Design 3 wild type
gggagaaagcuuaccaugaccagcaucggaaucgucggccuccugcugaccacagccauggcagccgagaucacuagacgugggagugcauacuacauguacuuggacaggagcgaugcugguaaggccauuucuuuugccaccacauugggggugaacaaaugccauguacagaucauggaccucgggcacaugugugacgccaccaugaguuaugagugccccaugcuagacgagggaguggagccagaugacgucgauugcuggugcaacacgacaucgacuuggguuguguacggaaccugucaucauaaaaaaggugaagcacgacgauccagaagagccgugacgcuuccuucucacuccacgaggaagcugcaaacgcgaucgcagacuuggcuagagucaagagaauacacaaagcaccugaucaagguugaaaauuggauauucaggaaccccggguuugcgcuaguggcuguagcuauagccuggcuccugggaagcucgacgagccaaaaaguuauauacuuggucaugauauuguugauugccccggcauacagcauuaggugcauaggaguuagcaauagagacuucguggagggcaugucaggugggaccuggguugauguugucuuggaacauggggguugcgucaccgugauggcacaggacaagccaacaguugauaucgaguuggucacgacaacgguuagcaacauggccgagguaagauccuacugcuaugaggcaucaauaucggacauggcuucggacagccguuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucauacggcccucgcuggagcuuuggaggcugagauggauggugcaaagggaaggcuauucucuggccauuugaaaugccgccuaaaaauggacaagcuuagguugaagggugugucauauucccuguguaccgcagcguucacauuuaccaaggucccagcugaaacauugcauggaacagucacaguggaggugcaguaugcagggacagacggacccugcaaagucccagcccagauggcgguggacaugcagacccugaccccaguuggaaggcugauaaccgccaauccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaguuggggguguguuuaauucauuggguaaggguauucaccagaucuuuggagcagcuuucaaaucacuguuuggaggaauguccugguucucacagauccucauaggcacacuguuggugugguuagguuugaacacaaagaauggaucuaucucccucacaugcuuagcccuggggggagugaugaucuuccuuuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7658 - RNA, 2290 nt, Artificial Sequence
  KF383118.1 prME-short mRNA Design 3 wild type
gggagaaagcuuaccaugaccagcaucggaaucauuggccuccugcugacuacagccauggcagcagagaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugagacacggcgaucuagaagaucugugucgcuccguuaucacuauacaaggaaguugcaaacgcggucgcagacaugguuagaaucaagagaauacaagaagcacuugaucauggucgaaaacuggauauucaggaaccccggguuugccauaguguccguugccauuaccuggcugaugggaagcuugacgagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7659 - RNA, 2287 nt, Artificial Sequence
  KX447520.1 prME-short mRNA Design 3 wild type
gggagaaagcuuaccaugagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7660 - RNA, 2290 nt, Artificial Sequence
  KU761561.1 prME-short mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaacuugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7661 - RNA, 2290 nt, Artificial Sequence
  KX806557.2 prME-short mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaacuggauguucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaaggucccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7662 - RNA, 2290 nt, Artificial Sequence
  LC191864.1 prME-short mRNA Design 3 wild type
gggagaaagcuuaccaugaccagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacaugacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugaccugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguccacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggagugguagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaacggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7663 - RNA, 2290 nt, Artificial Sequence
  KU744693.1 prME-short mRNA Design 3 wild type
gggagaaagcuuaccaugacuagugucggaauuguuggccuccugcugaccacagcuauggcagcggaggucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcucccuucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuauuggagcagcuuucaaaucauuguuuggaggaauguccugguucucacaaauucucauugggacguugcugaugugguugggucugaacacaaagaauggaucuauuucccuuaugugcuuggccuuagggggaguguugaucuucuuauccacagccgucucagguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7664 - RNA, 2281 nt, Artificial Sequence
  KU963574.2 prME-short mRNA Design 3 wild type
gggagaaagcuuaccaugggagcugaugccagcaucggaaucgucagccuccugcugacuacagucauggcagcagagaucacuagacgcgggagugcauacuacauguacuuggacaggagcgaugcugguaaggccauuucuuucguuaccacacugggggugaacaaaugccaugugcagaucauggaccucgggcauaugugugacgccaccaugaguuaugagugccccaugcuggacgagggaguggagccagaugacgucgauugcuggugcaacacgacaucaacuuggguuguguacggaaccugucaucauaaaaaaggugaagcacgacgauccagaagagccgugacgcuuccuucucacucuacaaggaaguugcaaacgcgaucgcagacuuggcuagaaucaagagaauacacaaagcaccugaucaagguugagaauuggauauucaggaaccccggguuugcgcuaguggcuguagcuauugccuggcuccugggaagcucgacgagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaguuggggguguguuuaacucauugggcaaggguauucaccagaucuuuggagcagcuuucaaaucacuguucggaggaauguccugguucucacagauccucauaggcacacuguuggugugguugggucugaacacaaagaauggaucuaucucccucacaugcuuggccuugggaggagugaugaucuuccuuuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7665 - RNA, 2299 nt, Artificial Sequence
  KF383120.1 prME-short mRNA Design 3 wild type
gggagaaagcuuaccaugggcgcagacaccagcaucggaaucauuggccuccugcugacuacagccauggcagcagagaucacuagacgcgggagugcauacuacauguacuuggauaggagcgaugccgggaaggccauuucguuugcuaccacaaugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcccucaagaagagcugucacgcuuccuucccauuccacaagaaaguuacagacacggucacaaaccuggcuugaaucacgggaguacacgaagcaccugaucaaaguugagaacuggauacuccggaauccaggguucacaguugcugcucuagcaauggccuggcucuugggaaauuccacgagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuguuggaggcguguucaauucucugggcaagggaguucaucaggucuucggagcagccuuuaaauccuuauuuggcggaauguccugguuuucacaaauucuuauuggcacacuuuuagugugguugggcuugaauacaaaaaauggauccauuucccuugcaugucuggcgcuuggaggggcgaugaucuuucucuccacggccgucucggcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7666 - RNA, 1582 nt, Artificial Sequence; identical to SEQ ID NO: 7441
  KU321639.1 solE mRNA Design 3 wild type

SEQ ID NO: 7667 - RNA, 1582 nt, Artificial Sequence; identical to SEQ ID NO: 7442
  KU312312.1 solE mRNA Design 3 wild type

SEQ ID NO: 7668 - RNA, 1570 nt, Artificial Sequence
  AY632535.2 solE mRNA Design 3 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7669 - RNA, 1582 nt, Artificial Sequence; identical to SEQ ID NO: 7444
  KU527068.1 solE mRNA Design 3 wild type

SEQ ID NO: 7670 - RNA, 1582 nt, Artificial Sequence
  KX421193.1 solE mRNA Design 3 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauugucaaugauacaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7671 - RNA, 1582 nt, Artificial Sequence
  LC002520.1 solE mRNA Design 3 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacaguugacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugacugucaaugauauaggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacacuggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7672 - RNA, 1564 nt, Artificial Sequence
  DQ859059.1 solE mRNA Design 3 wild type
gggagaaagcuuaccaugagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7673 - RNA, 1570 nt, Artificial Sequence
  KU963573.2 solE mRNA Design 3 wild type
gggagaaagcuuaccaugagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaccggauaaugcuaucagugcauggcucccagcauagcgggaugauuggauaugaaacugacgaaaauagagcgaaagucgagguuacgccuaauucaccaagagcggaagcaaccuugggaggcuuuggaagcuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauucaaggaugcccacgccaagaggcaaaccgucgucguucuggggagccaggaaggagccguucacacggcucucgcuggagcucuagaggcugagauggauggugcaaagggaaagcuguucucuggccauuugaaaugccgccuaaaaauggacaagcuuagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7674 - RNA, 1582 nt, Artificial Sequence
  KY075939.1 solE mRNA Design 3 wild type
gggagaaagcuuaccaugagccaaaaagucauauacuuggucaugauacugcugauugccccggcauacagccucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7675 - RNA, 1582 nt, Artificial Sequence
  KX447516.1 solE mRNA Design 3 wild type
gggagaaagcuuaccaugagcaaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7676 - RNA, 1582 nt, Artificial Sequence
  KX447515.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacugguacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7677 - RNA, 1582 nt, Artificial Sequence
  KU758874.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaagcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7678 - RNA, 1582 nt, Artificial Sequence
  KU729218.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaauaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacacgcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7679 - RNA, 1582 nt, Artificial Sequence
  KU501217.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagauaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguggaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7680 - RNA, 1582 nt, Artificial Sequence
  KU761561.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacuccaagaugaugcuggaacuugauccaccauuuggggacucuuacauugucauaggagucggggagaagaagaucacccaccacuggcacaggaguggcagcaccauuggaaaagcauuugaagccacugugagaggugccaggagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7681 - RNA, 1582 nt, Artificial Sequence
  KY075937.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacaugguuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuucucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7682 - RNA, 1582 nt, Artificial Sequence
  KY014317.1 solE mRNA Design 3 wild type
gggagaaagcuuaccaugagccaaaaagucauauacuuggucaugauacugcugauugccccggcauauagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccaccuugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcauugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7683 - RNA, 1582 nt, Artificial Sequence
  KU870645.1 solE mRNA Design 3 wild type
gggagaaagcuuaccaugagccaaaaagucauauauuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggaaucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7684 - RNA, 1582 nt, Artificial Sequence
  KU922923.1 solE mRNA Design 3 wild type
gggagaaagcuuaccaugagccaaaaagucauauacuuggucaugauacugcugauugcccuggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaauguugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcccagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7685 - RNA, 1582 nt, Artificial Sequence
  KU497555.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggggguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggacucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7686 - RNA, 1582 nt, Artificial Sequence
  KU312314.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguucuagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7687 - RNA, 1582 nt, Artificial Sequence
  KY014314.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagcuuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaagcacaugcuaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7688 - RNA, 1582 nt, Artificial Sequence
  KX447517.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccgcccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7689 - RNA, 1582 nt, Artificial Sequence
  KU729217.2 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuucaacaacagucagcaacauggcggagguaagauccuacugcuaugaggcaacaauaucagacauagcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugccgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7690 - RNA, 1582 nt, Artificial Sequence
  KY328290.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucuccaagaucccggcugaaacacugcacgggacagucacagaggagguacaguacgcagggacagauggaccuugcaagguuccagcucagauggcgguggacaugcaaacucugaccccaguugggagguugauaaccgcuaacccgguaaucacugaaagcacagagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7691 - RNA, 1582 nt, Artificial Sequence
  KX087101.3 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucugacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccgagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggaguuacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7692 - RNA, 1582 nt, Artificial Sequence
  KY003156.1 solE mRNA Design 3 wild type
gggagaaagcuuaccaugagccaaaaagucauauacuuggucaugauacugcugauugccccggcauacagcaucaggugcauaggaaucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaguaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaauccuaggacuggauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7693 - RNA, 1582 nt, Artificial Sequence
  KU758876.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggaugguguaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaaaaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuuaggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7694 - RNA, 1582 nt, Artificial Sequence
  KU926310.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguugguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcauugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcaggggcagauggacccugcaagguuccagcucagauggcgguggacaugcaaacucugaccccaguugggagguugauaaccgccaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7695 - RNA, 1582 nt, Artificial Sequence
  KU681081.3 solE mRNA Design 3 wild type
gggagaaagcuuaccaugagccaaaaagucauauacuuggucaugauacugcugauugccccggcauacagcaucaggugcauaggagucaguaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaacaacaagcacugguugguucacaaggagugguuccacgacauuccauuaccuuggcacacuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaggcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7696 - RNA, 1582 nt, Artificial Sequence
  KU744693.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguugugucaccgcaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauauguuugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugcucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguuggcucacaaggagugguuccacgacauuccauuaccuuggcacgcuggggcagccaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacaguggacgggacagucacaguggagggacaguacggagggacagauggaccuugcaagguuccagcucagauggcgguggacaugcagacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7697 - RNA, 1582 nt, Artificial Sequence
  EU545988.1 solE mRNA Design 3 wild type
gggagaaagcuuaccaugagccaaaaagucauauacuuggucaugauacugcugauugccccggcauacagcaucaggugcauaggagucagcaauagggacuuuguggaagguaugucaggugggacuuggguugauguugucuuggaacauggagguuguguuaccguaauggcacaggacaaaccggcugucgacauagagcugguuacaacaacagucagcaacauggcggagguaagauccuauugcuaugaggcaucaauaucggacauggcuucggacagccgcugcccaacacaaggugaagccuaccuugacaagcagucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagcugaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcaugcuggggcagacaccggaacuccacauuggaacaacaaagaagcauugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggacccugcaagguuccagcucagauggcgguggacaugcaaacucugaccccaguugggaggcugauaaccgcuaacccuguaaucacugaaagcacugagaacucuaagaugaugcuggaacuugauccaccauuuggggacucuuacauugucauaggagucggggagaagaagaucacccaucacuggcacaggaguggcagcaccauuggaaaagcauuugaagccacugugagaggugccaagagaauggcagucuugggagacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7698 - RNA, 1582 nt, Artificial Sequence
  KY007221.1 solE mRNA Design 3 wild type
gggagaaagcuuaccaugagccaaaaagucauauacuuggucaugauacugcugauugccccggcauauagcaucaggugcauaggagucaacaauagggacuuuguggaagguaugucaggugggacuuggguugaugucgucuuggaacauggagguugugucaccguaauggcacaggacaaaccgacugucgacauagagcugguuacaacaacagucagcaacauggcagagguaagauccuacugcuaugaggcaucaauaucggacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgccaaguuugcaugcuccaagaaaaugaccgggaagagcauccagccagagaaucuggaguaccgaauaaugcugucaguucauggcucccagcacagugggaugaucguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggaugcacaugccaaaaggcaaacugucgugguccuagggagucaagagggagcaguucacacggcucuugcuggagcucuggaggcugagauggauggugcaaagggaaggcuguccucuggccacuugaaaugucgccugaaaauggauaaacuuagacugaagggcgugucauacucccuguguaccgcagcguucacauucacuaagaucccggcugaaacacugcacgggacagucacaguggagguacaguacgcagggacagauggaccuugcaagguuccagcucagauggcgguggacaugcaaacucugaccccaguugggagguugauaaccgcuaacccuguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7699 - RNA, 1582 nt, Artificial Sequence
  KY003152.1 solE mRNA Design 3 wild type
gggagaaagcuuaccaugagccaaaaagucauauauuuggucaugauacugcugauugccccggcauacagcaucaggugcauaggagucagcaauagggacuuuguggaagguaugucaggugggacuuggguugauguugucuuggaacauggaggcuguguuaccguaauggcacaggacaaaccgacugucgacauagagcugguuacaacaacaguuagcaacauggcggagguaagauccuacugcuaugaggcaucaauaucggauauggcuucggacagccgcugcccaacacaaggugaggccuaccuugacaagcagucagacacucaauaugucugcaaaagaacguuaguggauagaggcuggggaaauggauguggacuuuuuggaaaagggagccuggugacaugcgcuaaguuugcaugcuccaagaaaaugaccgggaagagcauccagccagagaaccuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuaccugacuaugaauaacaagcacugguugguucacaaggagugguuccacgacauuccauuaccuuggcaugcuggggcagacacuggaacuccacauuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacucagauugaagggugugucauacuccuugugugcugcagcguucacauucaccaagaucccggcugaaacacugcacgggacagucacaguggagguacaguacgcagggacagauggaccuugcaagguuccagcucagauggcgguggauaugcaaacucugaccccaguugggagguugauaaccgcuaacccuguaaucacugaaagcaccgagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7700 - RNA, 1582 nt, Artificial Sequence
  KX694533.2 solE mRNA Design 3 wild type
gggagaaagcuuaccaugagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacauaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacuggcacaggaguggcagcaccaucggaaaagcauuugaagccacugugagaggcgccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7701 - RNA, 1582 nt, Artificial Sequence
  KX601167.1 solE mRNA Design 3 wild type
gggagaaagcuuaccaugagccaaaaagucauauacuuggucaugauacuguugauugccccggcauacaguaucaggugcauaggagucagcaauagggauuuuguggaagguaugucaggugggaccuggguugauguugucuuggaacauggagguuguguuaccguaauggcacaggacaagccaacuguugauauagaguuggucacaacaacgguuagcaacauggcggagguaagauccuacugcuacgaggcaucaauaucggacauggcuucggacagccgcugcccaacacaaggugaagccuaccuugacaagcagucagacacucaauauguuugcaaaagaacguuaguggacagagguuggggaaauggauguggacucuuuggcaaagggagccuggugacaugcgccaaguuugcaugcuccaagaaaaugacugggaagagcauccagccagagaaccuggaguaccggauaaugcugucaguucauggcucccagcacagugggaugauuguuaaugacacaggacaugaaacugaugagaauagagcgaagguugagauaacgcccaauucaccaagagccgaagccacccugggagguuuuggaagccuaggacuugauugugaaccgaggacaggccuugacuuuucagauuuguauuacuugacuaugaauaacaagcauugguuggugcacaaggagugguuccaugacauuccacuaccuuggcaugcuggggcagacaccggaacuccacauuggaacaacaaagaagcauugguagaguucaaggacgcacaugccaaaaggcaaacugucgugguucuagggagucaagaaggagccguucacacggcucuugcuggagcccuggaggcugagauggauggugcaaagggaaggcuguccucuggccacuugaaaugucgcuugaaaauggacaaacuuagauugaagggcgugucauacuccuuauguaccgcggcguucacauucaccaagaucccggcugaaacgcugcaugggacagucacaguggagguacaguaugcagggacagauggacccugcaagguuccagcucagauggcgguggauaugcaaacucugaccccaguugggagguugauaaccgcuaacccugugaucacugaaagcacugagaauucaaagaugauguuggaacuugacccaccauuuggggauucuuacauugucauaggaguuggggauaagaagaucacccaccacugguacaggaguggcagcaccaucggaaaagcauuugaagccacugugagaggcgccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7702 - RNA, 1582 nt, Artificial Sequence
  KY288905.1 solE mRNA Design 3 wild type
gggagaaagcuuaccaugagccaaaaagucauauacuuggucaugauacugcugauugccccggcauacaguaucaggugcauaggagucagcaauagagacuucguggagggcaugucaggugggaccuggguugacguuguccuggaacauggaggcugcgucaccgugauggcacaggacaagccaacaguugacauagagcuggucacaacaacgguuaguaacauggccgaggugagauccuauuguuacgaggcaucaauaucggacauggcuucggacagucgcugcccaacacaaggugaagccuaccuugacaagcaaucagacacucaauauguuugcaaaagaacauugguggacagagguuggggaaauggguguggacucuuuggcaaagggaguuuggugacaugugcuaaguucacgugcuccaagaagaugacugggaagagcauucagccggagaaccuggaguaucggauaaugcuaucagugcauggcucccagcacagugggaugauuguuaaugacacaggacaugaaacugaugaaaacagagcgaaggucgagguuacgcccaauucaccaagagcagaagcaacccugggaggcuuuggaagcuuaggacuugauugugaaccaaggacaggccuugacuuuucagaucuguauuaccuaaccaugaauaacaagcauugguuggugcacaaagagugguuucaugacaucccauugcccuggcaugcuggggcagacacuggaacuccacauuggaacaacaaggaggcauuaguggaauucaaggacgcccacgccaagaggcaaaccgucgugguuuuggggagccaggaaggagccguccacacggcucuugcuggagcucuagaggcugagauggauggugcaaagggaaggcuauucucuggccacuugaaaugucgcuuaaaaauggacaagcuuagauugaagggcgugucauauuccuugugcaccgcggcauucacauucaccaaggucccggcugaaacacuacauggaacagucacaguggaggugcaguaugcagggacagauggacccugcaaggucccagcccagauggcgguggacaugcagaccuugaccccagucggaaggcugauaaccgccaaccccgugauuacugaaagcacugagaauucaaagaugauguuggagcucgacccaccauuuggggauucuuacauugucauaggaguuggggauaagaaaaucacccaucacuggcauaggaguggcagcaccauuggaaaagcauuugaagccacugugagaggcgcuaagagaauggcaguccugggggacacagcuugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7703 - RNA, 1582 nt, Artificial Sequence
  KF268950.1 solE mRNA Design 3 wild type
gggagaaagcuuaccaugagccaaaaagucauauacuugguuaugauacugcugauugccccggcauacagcaucaggugcauuggagucagcaauagagacuucguggaaggcaugucaggugggaccuggguugaugucgucuuggaacauggagguugcgucaccguuauggcacaggacaagccaacaguugacauagaguuggucacgacaacgguuaguaacauggccgagguaagauccuacuguuaugaggcaucaauaucagacauggcuucggacagucgcugcccaacacaaggugaagccuaccuugauaagcaaucagacacccaauaugugugcaaaagaacauugguggacagagguuggggaaauggguguggacuuuuuggcaaagggagccuggugacaugugccaaguucacguguuccaagaagaugacugggaagagcauucagccggagaaucuggaguaucgaauaaugcuaucagugcauggcucccagcacagcgggaugauuguuaaugacauaggacaugaaacugacgaaaacagagcgaaagucgaggucacgcccaauucaccaagagcagaagcaaccuugggaggcuuuggaagcuuaggacuugauugugaaccaaggacaggccuggacuuuucagauuuguacuacuugaccaugaacaacaagcacugguuggugcacaaagagugguuucaugacaucccauugccuuggcaugcuggggcagauaccggaacuccacacuggaacaacaaggaggcauugguagaguucaaagaugcccacgccaagaggcaaaccgucguuguucuagggagccaggaaggagccguucacacggcucuugcuggagcucuggaggcugagauggauggugcaaaaggaaggcuguucuccggccauuugaaaugccgcuuaaaaauggacaagcuuagauugaagggcgugucauauuccuugugcaccgcagcguucacauuuaccaaggucccagcugaaacauugcauggaacaguuacaguggaggugcaguaugcagggacagauggacccugcaaggucccagcccagauggcgguggacaugcagacccugaccccagucgggaggcugauaaccgccaacccugugauuacugaaagcacugagaauucaaagaugauguuggagcucgacccaccauuuggggauucuuacauugucauaggaguuggggacaagaaaaucacccaucacuggcauaggagugguagcaccaucggaaaagcauuugaggccacugugagaggugccaagagaauggcaguucugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7704 - RNA, 1582 nt, Artificial Sequence
  KF383116.1 solE mRNA Design 3 wild type
gggagaaagcuuaccaugagccaaaaagucauauacuugguaaugauauuguugauugccccggcauacagcaucaggugcauaggaguuagcaauagagacuucguggagggcaugucaggugggaccuggguugauguugucuuggaacauggggguugcgucaccgugauggcacaggacaagccaacaguugacaucgaguuggucacgacaacgguuagcaacauggccgagguaagauccuacugcuaugaggcaucaauaucggacauggcuucggacagccgcuguccaacacaaggugaagccuaccuugacaagcagucagacacucaauaugucugcaagagaacauugguggauagagguuggggaaauggguguggacuuuuuggcaaagggagcuuggugacaugugccaaguuuacgugcuccaagaaaaugacaggcaagagcauccagccggagaacuuggaguaccggauaaugcuaucagugcauggaucccagcacagugggaugauugugaaugacauaggacaugaaacugacgaaaacagagcaaaagucgaggucacacccaauucaccaagagcagaagcaaccuugggagguuuuggaagcuugggacuugacugugaaccaaggacaggccuugacuucucagaucuguauuaccugaccaugaacaauaagcauugguuggugcacaaggagugguuucaugacaucccauuaccuuggcaugcuggugcagacacuggaacuccacacuggaacaacaaagaggcauugguggaguuuaaggacgcccacgccaagaggcaaacuguugugguucuggggagccaagagggagcuguucacacggcccucgcuggagcuuuggaggcugagauggauggugcaaagggaaggcuauucucuggccauuugaaaugccgccuaaaaauggacaagcuuagguugaagggugugucauauucccuguguaccgcaguguguaccgcagcgaaggucccagcugaaacauugcauggaacagucacaguggaggugcaguaugcagggacagauggacccugcaaggucccagcccagauggcgguagacaugcagacccugaccccaguuggaaggcugauaaccgccaacccugugaucacugaaaguacugagaauucaaagaugauguuggagcucgacccaccauuuggggauucuuacauugucauaggagucggggacaagaaaaucacccaucacuggcaucggagugguagcaccaucggaaaggcauuugaagccacugugagaggugccaagagaauggcagucuugggggacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7705 - RNA, 1564 nt, Artificial Sequence
  KU963574.2 solE mRNA Design 3 wild type
gggagaaagcuuaccaugagccaaaaagucauauacuuggucaugauauuguugauugccccggcauacaguaucaggugcauaggaguuagcaauagagacuucguggagggcaugucaggugggaccuggguugauguugucuuggaacauggagguugugucaccgugauggcacaggacaagccaacaguugacauagaguuggucacgacaacgguuagcaacauggccgaggugagauccuacugcuacgaggcaucaauaucggacauggcuucggacagucgcugcccaacacaaggugaagccuaccuugacaagcagucagacacucaauaugucuguaaaagaacauugguggacagagguuggggaaauggguguggacuuuuuggcaaggggagcuuggugacgugugccaaguuuacaugcuccaagaaaaugacagggaagagcauccagccggagaacuuggaguaccggauaaugcuaucagugcauggaucccagcacagugggaugauugugaaugacgaaaacagagcaaaagucgagguuacacccaauucaccaagagcagaagcaaccuugggagguuuuggaagccugggacuugauugugaaccaaggacaggccuugacuuuucagaucuguauuaccugaccaugaacaauaagcauugguuggugcacaaagagugguuucaugacaucccauuaccuuggcauucuggugcagacacugaaacuccacacuggaacaacaaagaggcacugguggaguucaaggacgcccacgccaagaggcaaacuguugugguucuggggagccaagaaggagccguucacacggcucucgcuggagcucuggaggcugagauggauggugcgaagggaaggcuauccucaggccauuugaaaugccgccuaaaaauggacaagcuuagguugaagggugugucauauucccuguguaccgcagcguucacauucaccaagguuccagcugaaacauugcauggaacagucacaguggaggugcaguaugcagggagggauggacccugcaaggucccagcccagauggcgguggacaugcagacccugaccccaguuggaaggcugauaacggcuaacccugugaucacugaaagcacugagaauucaaagaugauguuggagcucgacccaccauuuggggauucuuacauugucauaggagucggggacaagaaaaucacccaucacuggcaucggagugguagcaucaucggaaaggcauuugaagccacugugagaggcgccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7706 - RNA, 1582 nt, Artificial Sequence
  KF383118.1 solE mRNA Design 3 wild type
gggagaaagcuuaccaugagccaaaaagucauauacuuggucaugauaguguugauugucccggcauacaguaucagcugcauuggagucagcaauagagacuuaguggagggcaugucaggugggaccuggguugauguugucuuggaacauggagggugcguuaccgagauggcacaggacaagccaacaguugacauagaguuggucacgaugacgguuaguaacauggccgagguaagauccuauugcuacgaggcaucguuauccgacauggcuucggccagucguugcccaacacaaggcgaacccucccucgacaagcaaucagacacucaaucuguaugcaaaagaacauuaggagacagagguuggggaaaugguugugggauuuuuggcaaagggagcuuggugacauguuccaaguucacguguuguaagaagaugcccgggaagagcauucaaccggaaaaucuggaguaucggauaaugcucccagugcauggcucccagcauagcgggaugauugugaaugacauaggacaugaaacugacgaaaacagagcgaaagucgaggucacacccaauucaccaagagcagaagcaaccuugggagguuuuggaagcuugggacuugacugugaaccaaggacaggccuugacuucucagaucuguauuaucugaccaugaacaacaagcauugguuggugcacaaggagugguuucaugacaucccauuaccuuggcaugcuggugcagacacuggaacuccacacuggaacaacaaagaggcauugguggaguucaaggacgcccacgccaagaggcaaacuguugugguucuggggagccaagagggagcuguucacacggcccucgcuggagcucuggaggcugagauggauggugcaaagggaaggcuauucucuggccauuugaaaugccgccuaaaaauggacaagcuuagguugaagggugugucauauucccuguguacugcagcguucacauuuaccaaggucccagcugaaacauugcauggaacaguuacaguggaggugcagucugcagggacagauggacccugcaaggucccagcccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaagccacugugagaggcgccaagagaauggcaguccugggggauacagccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7707 - RNA, 1582 nt, Artificial Sequence
  KX520666.1 solE mRNA Design 3 wild type
gggagaaagcuuaccaugcgccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuagaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacugauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacuccuacauugucauaggagucggggagaagaagaucacccaccacuggcacaggaguggcagcaccauuggaaaagcauuugaagccacugugagaggugccaagagaauggcagucuugggagacacagccugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7708 - RNA, 1582 nt, Artificial Sequence
  KF383120.1 solE mRNA Design 3 wild type
gggagaaagcuuaccaugagccagcgagugaucuaucuggugaugauccuguugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggagaauuuggaguacagaauuaugcugucagugcacggcucccaacacagcgggaugauugugaaugacauaggacaugagaccgaugaaaacagagcaaaaguggaggucacaccaaacucaccaagagcugaagcgacccuagggggcuucgggaguuugggacucgauugugagccaaggaccgguuuagauuucuccgaccuguacuauuuaaccaugaacaacaagcauugguuggugcacaaggagugguuccacgacauuccauugccauggcacgcuggagcggacacagggacuccccauuggaacaacaaagaggcauugguugaguucaaggaugcccacgccaaaagacagacuguugucguguugggaagucaggagggugccguccacacagcccuggcaggagcuuuggaagcggagauggauggagccaaaggaaggcuguucucaggucauuugaagugccggauaaagauggacaagcuuagguugaagggugucucauacucauugugcacugccgccuucacauucucaaagguuccggcugaaacgcugcaugggacagucacaguugaggugcaguaugcgggcagagauggaccuugcaaggugccagcccaaauggcaguggauaugcagacucuuaccccagugggaagguugauaacggcaaaucccaucauaacugagagcacugaaaacucgagaaugauguuggagcuggacccacccuuuggagacucuuacauugucauugggguuggagauaagaaaauuacccaucauuggcacagaaguggaagcacgauugggaaggcauuugaggccacugugagaggugcaaaaaggauggcaguccugggagauaccgccugggauuuugguucuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7709 - RNA, 2365 nt, Artificial Sequence
  R4804/R4834 ZIKV (strain ZikaSPH2015) Polyprotein(93-804) mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7710 - RNA, 2365 nt, Artificial Sequence
  R4816/R4838 ZIKV (isolate Z1106033) Polyprotein(93-804) mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7711 - RNA, 2353 nt, Artificial Sequence
  R4820/R4842 ZIKV (strain MR 766) Polyprotein(93-800) mRNA Design 3 GC
gggagaaagcuuaccaugcggaucaucaacgcccgcaaggagcggaagcgccggggcgccgacaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7712 - RNA, 2365 nt, Artificial Sequence
  R4868/R5082 ZIKV (strain NatalRGN) Polyprotein(93-804) mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7713 - RNA, 2290 nt, Artificial Sequence
  R4880/R5081 ZIKV (strain ZikaSPH2015) Polyprotein(108-794) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7714 - RNA, 2290 nt, Artificial Sequence
  ZIKV (isolate Z1106033) Polyprotein(108-794) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7715 - RNA, 2278 nt, Artificial Sequence
  ZIKV (strain MR 766) Polyprotein(108-790) mRNA Design 3 GC
gggagaaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7716 - RNA, 2290 nt, Artificial Sequence
  R4870/R5083 ZIKV (strain NatalRGN) Polyprotein(108-794) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7717 - RNA, 1582 nt, Artificial Sequence
  R4826/R4846 ZIKV (strain ZikaSPH2015) Polyprotein(273-723) mRNA Design 3 GC
gggagaaagcuuaccaugagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7718 - RNA, 1582 nt, Artificial Sequence
  R4825/R4845 ZIKV (isolate Z1106033) Polyprotein(273-723) mRNA Design 3 GC
gggagaaagcuuaccaugagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7719 - RNA, 1570 nt, Artificial Sequence
  ZIKV (strain MR 766) Polyprotein(273-719) mRNA Design 3 GC
gggagaaagcuuaccaugucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7720 - RNA, 1582 nt, Artificial Sequence
  ZIKV (strain NatalRGN) Polyprotein(273-723) mRNA Design 3 GC
gggagaaagcuuaccaugagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7721 - RNA, 2290 nt, Artificial Sequence
  ZIKV (strain ZikaSPH2015) Polyprotein(108-794)(F398S) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuccgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7722 - RNA, 2290 nt, Artificial Sequence
  ZIKV (isolate Z1106033) Polyprotein(108-794)(F398S) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7723 - RNA, 2278 nt, Artificial Sequence
  ZIKV (strain MR 766) Polyprotein(108-790)(F398S) mRNA Design 3 GC
gggagaaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguccggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7724 - RNA, 2290 nt, Artificial Sequence
  ZIKV (strain NatalRGN) Polyprotein(108-794)(F399S) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuccgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7725 - RNA, 2290 nt, Artificial Sequence
  ZIKV (strain ZikaSPH2015) Polyprotein(108-794)(N444Q) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucguccaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7726 - RNA, 2290 nt, Artificial Sequence
  ZIKV (isolate Z1106033) Polyprotein(108-794)(N444Q) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7727 - RNA, 2290 nt, Artificial Sequence
  ZIKV (strain NatalRGN) Polyprotein(108-794)(N444Q) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugcaggacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7728 - RNA, 2290 nt, Artificial Sequence
  ZIKV (strain ZikaSPH2015) Polyprotein(108-694)-Cterm-JAEV1-E(400-500) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7729 - RNA, 2290 nt, Artificial Sequence
  ZIKV (isolate Z1106033) Polyprotein(108-694)-Cterm-JAEV1-E(400-500) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7730 - RNA, 2278 nt, Artificial Sequence
  ZIKV (strain MR 766) Polyprotein(108-690)-Cterm-JAEV1-E(400-500) mRNA Design 3 GC
gggagaaagcuuaccaugaccagcaucgggaucaucggccugcugcucacgaccgccauggcggccgagaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7731 - RNA, 2290 nt, Artificial Sequence
  ZIKV (strain NatalRGN) Polyprotein(108-694)-Cterm-JAEV1-E(400-500) mRNA Design 3 GC
gggagaaagcuuaccaugaccagcguggggaucgugggccuccugcugacgaccgccauggcggccgaggucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7732 - RNA, 2365 nt, Artificial Sequence
  R5620 ZIKV (strain ZikaSPH2015) Polyprotein(93-804) mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7733 - RNA, 2362 nt, Artificial Sequence
  ZIKV prME variant mRNA Design 3 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7734 - RNA, 2359 nt, Artificial Sequence
  ZIKV prME variant mRNA Design 3 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7735 - RNA, 2356 nt, Artificial Sequence
  ZIKV prME variant mRNA Design 3 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7736 - RNA, 2353 nt, Artificial Sequence
  ZIKV prME variant mRNA Design 3 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7737 - RNA, 2350 nt, Artificial Sequence
  ZIKV prME variant mRNA Design 3 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7738 - RNA, 2347 nt, Artificial Sequence
  ZIKV prME variant mRNA Design 3 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7739 - RNA, 2344 nt, Artificial Sequence
  ZIKV prME variant mRNA Design 3 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7740 - RNA, 2341 nt, Artificial Sequence
  ZIKV prME variant mRNA Design 3 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7741 - RNA, 2338 nt, Artificial Sequence
  ZIKV prME variant mRNA Design 3 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7742 - RNA, 2335 nt, Artificial Sequence
  ZIKV prME variant mRNA Design 3 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7743 - RNA, 2332 nt, Artificial Sequence
  ZIKV prME variant mRNA Design 3 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7744 - RNA, 2329 nt, Artificial Sequence
  ZIKV prME variant mRNA Design 3 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7745 - RNA, 2326 nt, Artificial Sequence
  ZIKV prME variant mRNA Design 3 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7746 - RNA, 2323 nt, Artificial Sequence
  ZIKV prME variant mRNA Design 3 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7747 - RNA, 2320 nt, Artificial Sequence
  ZIKV prME variant mRNA Design 3 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7748 - RNA, 2320 nt, Artificial Sequence
  ZIKV prME variant mRNA Design 3 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7749 - RNA, 2332 nt, Artificial Sequence
  ZIKV prME variant mRNA Design 3 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7750 - RNA, 2356 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7751 - RNA, 2356 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7752 - RNA, 2347 nt, Artificial Sequence
  ZIKV prME variant mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7753 - RNA, 2344 nt, Artificial Sequence
  ZIKV prME variant mRNA Design 3 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7754 - RNA, 2341 nt, Artificial Sequence
  ZIKV prME variant mRNA Design 3 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7755 - RNA, 2338 nt, Artificial Sequence
  ZIKV prME variant mRNA Design 3 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7756 - RNA, 2335 nt, Artificial Sequence
  ZIKV prME variant mRNA Design 3 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7757 - RNA, 2332 nt, Artificial Sequence
  ZIKV prME variant mRNA Design 3 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7758 - RNA, 2329 nt, Artificial Sequence
  ZIKV prME variant mRNA Design 3 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7759 - RNA, 2326 nt, Artificial Sequence
  ZIKV prME variant mRNA Design 3 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7760 - RNA, 2323 nt, Artificial Sequence
  ZIKV prME variant mRNA Design 3 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7761 - RNA, 2320 nt, Artificial Sequence
  ZIKV prME variant mRNA Design 3 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7762 - RNA, 2317 nt, Artificial Sequence
  ZIKV prME variant mRNA Design 3 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7763 - RNA, 2314 nt, Artificial Sequence
  ZIKV prME variant mRNA Design 3 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7764 - RNA, 2311 nt, Artificial Sequence
  ZIKV prME variant mRNA Design 3 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7765 - RNA, 2308 nt, Artificial Sequence
  ZIKV prME variant mRNA Design 3 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7766 - RNA, 2305 nt, Artificial Sequence
  ZIKV prME variant mRNA Design 3 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7767 - RNA, 2302 nt, Artificial Sequence
  ZIKV prME variant mRNA Design 3 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7768 - RNA, 2302 nt, Artificial Sequence
  ZIKV prME variant mRNA Design 3 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7769 - RNA, 2314 nt, Artificial Sequence
  ZIKV prME variant mRNA Design 3 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7770 - RNA, 2338 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7771 - RNA, 2338 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacguggggugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7772 - RNA, 2338 nt, Artificial Sequence
  ZIKV prME variant mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7773 - RNA, 2335 nt, Artificial Sequence
  ZIKV prME variant mRNA Design 3 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7774 - RNA, 2332 nt, Artificial Sequence
  ZIKV prME variant mRNA Design 3 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7775 - RNA, 2329 nt, Artificial Sequence
  ZIKV prME variant mRNA Design 3 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7776 - RNA, 2326 nt, Artificial Sequence
  ZIKV prME variant mRNA Design 3 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7777 - RNA, 2323 nt, Artificial Sequence
  ZIKV prME variant mRNA Design 3 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7778 - RNA, 2320 nt, Artificial Sequence
  ZIKV prME variant mRNA Design 3 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7779 - RNA, 2317 nt, Artificial Sequence
  ZIKV prME variant mRNA Design 3 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7780 - RNA, 2314 nt, Artificial Sequence
  ZIKV prME variant mRNA Design 3 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7781 - RNA, 2311 nt, Artificial Sequence
  ZIKV prME variant mRNA Design 3 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7782 - RNA, 2308 nt, Artificial Sequence
  ZIKV prME variant mRNA Design 3 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7783 - RNA, 2305 nt, Artificial Sequence
  ZIKV prME variant mRNA Design 3 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7784 - RNA, 2302 nt, Artificial Sequence
  ZIKV prME variant mRNA Design 3 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7785 - RNA, 2299 nt, Artificial Sequence
  ZIKV prME variant mRNA Design 3 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7786 - RNA, 2296 nt, Artificial Sequence
  ZIKV prME variant mRNA Design 3 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7787 - RNA, 2293 nt, Artificial Sequence
  ZIKV prME variant mRNA Design 3 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7788 - RNA, 2293 nt, Artificial Sequence
  ZIKV prME variant mRNA Design 3 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7789 - RNA, 2305 nt, Artificial Sequence
  ZIKV prME variant mRNA Design 3 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7790 - RNA, 2329 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7791 - RNA, 2329 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7792 - RNA, 2335 nt, Artificial Sequence
  ZIKV prME variant mRNA Design 3 GC
gggagaaagcuuaccaugcggaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7793 - RNA, 2329 nt, Artificial Sequence
  ZIKV prME variant mRNA Design 3 GC
gggagaaagcuuaccaugaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7794 - RNA, 2332 nt, Artificial Sequence
  ZIKV prME variant mRNA Design 3 GC
gggagaaagcuuaccaugaucaucaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7795 - RNA, 2326 nt, Artificial Sequence
  ZIKV prME variant mRNA Design 3 GC
gggagaaagcuuaccaugaacgcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7796 - RNA, 2323 nt, Artificial Sequence
  ZIKV prME variant mRNA Design 3 GC
gggagaaagcuuaccauggcccgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7797 - RNA, 2320 nt, Artificial Sequence
  ZIKV prME variant mRNA Design 3 GC
gggagaaagcuuaccaugcgcaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7798 - RNA, 2317 nt, Artificial Sequence
  ZIKV prME variant mRNA Design 3 GC
gggagaaagcuuaccaugaaggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7799 - RNA, 2314 nt, Artificial Sequence
  ZIKV prME variant mRNA Design 3 GC
gggagaaagcuuaccauggagaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7800 - RNA, 2311 nt, Artificial Sequence
  ZIKV prME variant mRNA Design 3 GC
gggagaaagcuuaccaugaagaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7801 - RNA, 2308 nt, Artificial Sequence
  ZIKV prME variant mRNA Design 3 GC
gggagaaagcuuaccaugaagcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7802 - RNA, 2305 nt, Artificial Sequence
  ZIKV prME variant mRNA Design 3 GC
gggagaaagcuuaccaugcggcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7803 - RNA, 2302 nt, Artificial Sequence
  ZIKV prME variant mRNA Design 3 GC
gggagaaagcuuaccaugcgcggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7804 - RNA, 2299 nt, Artificial Sequence
  ZIKV prME variant mRNA Design 3 GC
gggagaaagcuuaccaugggcgccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7805 - RNA, 2296 nt, Artificial Sequence
  ZIKV prME variant mRNA Design 3 GC
gggagaaagcuuaccauggccgacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7806 - RNA, 2293 nt, Artificial Sequence
  ZIKV prME variant mRNA Design 3 GC
gggagaaagcuuaccauggacaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7807 - RNA, 2290 nt, Artificial Sequence
  R5616 ZIKV (strain ZikaSPH2015) Polyprotein(108-794) mRNA Design 3 GC
gggagaaagcuuaccaugaccagcguggggaucgugggccuccugcugacgaccgccauggcggccgaggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7808 - RNA, 2290 nt, Artificial Sequence
  ZIKV prME variant mRNA Design 3 GC
gggagaaagcuuaccaugaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7809 - RNA, 2302 nt, Artificial Sequence
  ZIKV prME variant mRNA Design 3 GC
gggagaaagcuuaccaugcgcggcgccgacaccagcguggggaucgugggccuccugcugacgaccgccauggcggccgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7810 - RNA, 2326 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcggggucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7811 - RNA, 2326 nt, Artificial Sequence
  ZIKV prME variant mRNA Design 3 GC
gggagaaagcuuaccaugcggggccugagcucccgcaagcggcgcagccacgacgugcucaccguccaguuccugauccuggggaugcuccugaugaccggcgcagucacccggcgcggcagcgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaaguccauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7812 - RNA, 2365 nt, Artificial Sequence; identical to SEQ ID NO: 7709
  KU321639.1 prME-long mRNA Design 3 GC

SEQ ID NO: 7813 - RNA, 2365 nt, Artificial Sequence; identical to SEQ ID NO: 7710
  KU312312.1 prME-long mRNA Design 3 GC

SEQ ID NO: 7814 - RNA, 2353 nt, Artificial Sequence; identical to SEQ ID NO: 7711
  AY632535.2 prME-long mRNA Design 3 GC

SEQ ID NO: 7815 - RNA, 2365 nt, Artificial Sequence; identical to SEQ ID NO: 7712
  KU527068.1 prME-long mRNA Design 3 GC

SEQ ID NO: 7816 - RNA, 2365 nt, Artificial Sequence
  KU720415.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7817 - RNA, 2347 nt, Artificial Sequence
  DQ859059.1 prME-long mRNA Design 3 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacacggggaccccgcacuggaacaacaaggaggcccugguggaguucaaggacgcccacgccaagcggcagaccgucguggugcucggcagccaggagggggcgguccacaccgcccuggccggcgcccuggaggcggagauggacggggccaagggccgccucuucuccggccaccugaagugccggcugaagauggacaagcuccgccugaagggggugagcuacucccugugcacggccgccuucaccuucaccaaggugcccgccgagacccuccacggcaccgucacgguggaggugcaguacgcggggaccgacggccccugcaagguccccgcccagauggccguggacaugcagacccugaccccggugggccggcugaucacggccaaccccgucaucaccgagagcaccgagaacuccaagaugaugcucgagcuggacccgcccuucggggacagcuacaucgugaucggcgugggggacaagaagaucacccaccacuggcaccgcuccggcagcacgaucgggaaggccuucgaggcgaccguccggggcgccaagcgcauggccgugcugggcgacaccgccugggacuucgggagcgugggcggggucuucaacucccucggcaaggggauccaccagaucuucggcgccgcguucaagagccuguucggcgggauguccugguucagccagauccugaucggcacccugcucguguggcuggggcugaacacgaagaacggcuccaucagccugaccugccuggcccucgggggcgugaugaucuuccucuccaccgccgucagcgccgacgugggcugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7818 - RNA, 2365 nt, Artificial Sequence
  KX377335.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccgcaagaagggcgaggcccggcgcagccggcgcgcggugacccuccccucccacagcacccggaagcugcagacccgcucccagacguggcuggagagccgggaguacaccaagcaccucaucaaggucgagaacuggaucuuccgcaaccccggguucgcccugguggccguggccaucgccuggcugcucggcuccagcaccucccagaaggucaucuaccuggugaugauccugcucaucgcgcccgccuacagcauccggugcaucgggguguccaaccgcgacuucgucgagggcaugagcggcgggaccuggguggacgugguccuggagcacggcgggugcgugacggugauggcccaggacaagccgaccgucgacaucgagcuggugaccaccacgguguccaacauggccgagguccggagcuacugcuacgaggccuccaucagcgacauggcgagcgacucccgcugccccacccagggcgaggccuaccucgacaagcagagcgacacccaguacgugugcaagcggacccugguggaccgcggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaccggcuacgagaccgacgagaaccgggccaagguggaggugacccccaacuccccgcgcgccgaggcgacccucgggggcuucgggagccugggccuggacugcgagccccggaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcgccagaccguggucgugcucgggagccaggagggcgccgugcacacggcccuggccggggcgcuggaggccgagauggacggcgccaagggcaagcuguucuccgggcaccucaagugccggcugaagauggacaagcuccgccugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcggcugaucaccgccaaccccgugaucaccgagagcaccgagaacuccaagaugaugcucgagcuggacccgcccuucggcgacagcuacaucgucaucggggugggcgacaagaagaucacgcaccacuggcaccgcuccgggagcaccaucggcaaggccuucgaggcgaccgugcggggcgccaagcgcauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7819 - RNA, 2365 nt, Artificial Sequence
  LC002520.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaccgucaacgacaucggcuacgagaccgacgagaaccgcgccaagguggaggugacccccaacuccccgcgggccgaggcgacccucgggggcuucgggagccugggccuggacugcgagccccgcaccggccucgacuucuccgaccuguacuaccugacgaugaacaacaagcacuggcucguccacaaggagugguuccacgacaucccccugcccuggcacgccggggccgacaccggcaccccgcacuggaacaacaaggaggcccugguggaguucaaggacgcccacgcgaagcggcagaccguggucgugcucgggagccaggagggcgccgugcacacggcccuggccggggcgcuggaggccgagauggacggcgccaagggcaagcuguucuccgggcaccucaagugccgccugaagauggacaagcuccggcugaagggcgucagcuacucccugugcaccgccgccuucaccuucaccaaggugcccgcggagacccuccacgggacggugaccgucgaggugcaguacgccggcaccgacggccccugcaagauccccgugcagauggccgucgacaugcagacccugacgccgguggggcgccugaucaccgccaaccccgugaucaccgagagcaccgagaacuccaagaugaugcucgagcuggacccgcccuucggcgacagcuacaucgucaucggggugggcgacaagaagaucacgcaccacuggcaccgguccgggagcaccaucggcaaggccuucgaggcgaccgugcgcggcgccaagcggauggccguccugggggacaccgccugggacuucggcagcgucgggggcguguucaacucccucgggaagggcauccaccagaucuucggcgccgcguucaagagccuguucgggggcauguccugguucagccagauccugaucgggacgcugcucguguggcugggccugaacaccaagaacggguccaucagccugaccugccucgcccugggcggcgugaugaucuuccucuccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7820 - RNA, 2353 nt, Artificial Sequence
  KU963573.2 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucggcuacgagaccgacgagaaccgcgccaaggucgaggugacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccuggucgaguucaaggacgcccacgcgaagcggcagaccguggugguccucgggagccaggagggcgccgugcacaccgcccuggccggggcgcuggaggccgagauggacggcgccaagggcaagcuguucuccgggcaccucaagugccgccugaagauggacaagcuccggcugaagggcgugagcuacucccugugcacggccgccuucaccuucaccaagguccccgcggagacccuccacgggaccgugacgguggagguccaguacgccggcaccgacggccccugcaagauccccgugcagauggccguggacaugcagacccugaccccggucgggcgccugaucacggccaaccccgugaucaccgagagcaccgagaacuccaagaugaugcucgagcuggacccgcccuucggcgacagcuacaucgugaucggggucggcgacaagaagaucacccaccacuggcaccgguccgggagcacgaucggcaaggccuucgaggcgaccgugcgcggcgccaagcggauggccgugcugggggacaccgccugggacuucggcagcgucgggggcguguucaacucccucgggaagggcauccaccagaucuucggcgccgcguucaagagccuguucgggggcauguccugguucagccagauccugaucgggacccugcucguguggcugggccugaacacgaagaacggguccaucagccugaccugccucgcccugggcggcgucaugaucuuccucuccaccgccgugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7821 - RNA, 2365 nt, Artificial Sequence
  KX694534.2 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggcggggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7822 - RNA, 2365 nt, Artificial Sequence
  KX447520.1 prME-long mRNA Design 3 GC
gggagaaagcuuaccaugcgcaucaucaacgcccggaaggagaagaagcgccggggcgccgacgcgagcguggggaucgucggccugcuccugaccaccgccauggccgccgaggugacgcgccggggguccgccuacuacauguaccuggaccgcaacgacgcgggcgaggccaucagcuuccccaccacccucgggaugaacaagugcuacauccagaucauggaccugggccacaugugcgacgccaccauguccuacgagugcccgaugcuggacgagggcguggagcccgacgacgucgacugcuggugcaacacgaccagcaccugggugguguacgggaccugccaccacaagaagggcgaggcccggcgcucccggcgcgcggucacgcuccccagccacuccacccggaagcugcagacccgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7823 - RNA, 2365 nt, Artificial Sequence
  KX369547.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccgggcuggcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7824 - RNA, 2365 nt, Artificial Sequence
  KX447515.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacugguaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7825 - RNA, 2365 nt, Artificial Sequence
  KU501217.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgagauccgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7826 - RNA, 2365 nt, Artificial Sequence
  KU312314.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugcuggcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7827 - RNA, 2365 nt, Artificial Sequence
  KX446950.2 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgacccuggacgagggcguggagcccgacgacgucgacugcuggugcaacaccaccagcacgugggugguguacgggaccugccaccacaagaagggcgaggcccggcgcucccggcgcgccgucacccuccccagccacuccacccggaagcugcagacgcgcagccagaccuggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggcgagcaucuccgacauggccagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucgccugcuccaagaagaugaccggcaagagcauccagcccgagaaccuggaguaccgcaucaugcuguccguccacggcagccagcacuccgggaugaucgugaacgacaccggccacgagacggacgagaaccgcgcgaaggucgagaucaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgagagcaccgagaacuccaagaugaugcucgagcuggacccgcccuucggcgacagcuacaucgucaucggggugggcgagaagaagaucacgcaccacuggcaccgcuccgggagcaccaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7828 - RNA, 2365 nt, Artificial Sequence
  KY003157.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccguggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7829 - RNA, 2365 nt, Artificial Sequence
  KX811222.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcgccugggugguguacgggaccugccaccacaagaagggcgaggcccggcgcucccggcgcgcggucacgcuccccagccacuccacccggaagcugcagacccgcccccagaccuggcuggagagccgggaguacacgaagcaccucauccgcguggagaacuggaucuuccggaacccgggguucgcccuggccgccgccgcgaucgccuggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggcggaggugcgcagcuacugcuacgaggccuccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgcgugcagcaagaagaugacgggcaaguccauccagccggagaaccuggaguaccgcaucaugcugagcguccacggcucccagcacagcgggaugaucgugaacgacaccggccacgagaccgacgagaaccgcgccaaggucgagaucacccccaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccgcugcccuggcacgccggggcggacaccggcacgccccacuggaacaacaaggaggcccugguggaguucaaggacgcccacgccaagcggcagaccgucguggugcucgggagccaggagggcgcgguccacaccgcccuggccggggcccuggaggccgagauggacggcgcgaagggccgccucuccagcgggcaccugaagugccggcugaagauggacaagcuccgccugaagggcguguccuacagccugugcaccgccgccuucacguucaccaagauccccgccgagacccuccacgggaccgugaccgucgaggugcaguacgccggcacggacggcccgugcaaggugcccgcgcagauggccgucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgcgaagcgcauggccguccugggggacaccgccugggacuucggcagcgucgggggcgcccucaacagccuggggaagggcauccaccagaucuucggcgcggccuucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7830 - RNA, 2365 nt, Artificial Sequence
  KX447516.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagcaagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7831 - RNA, 2365 nt, Artificial Sequence
  KX520666.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccacccgccagaaggugaucuaccuggucaugauccugcucaucgccccggccuacagcauccggugcaucgggguguccaaccgcgacuucguggagggcaugagcggcgggaccugggucgacguggugcuggagcacggcgggugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgggcgaaggucgagaucacgccgaacagcccccgcgccgaggccacccucgggggcuucgggucccugggccuggacugcgagccccggaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggagccaggagggcgccguccacaccgcgcuggccggggcccuggaggccgagauggacggcgccaagggccggcucuccagcgggcaccugaagugccgccugaagauggacaagcuccggcugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgaguccaccgagaacagcaagaugaugcucgagcuggacccgcccuucggcgacuccuacaucgucaucggggugggcgagaagaagaucacccaccacuggcaccggagcggguccacgaucggcaaggccuucgaggccaccgugcgcggcgccaagcggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7832 - RNA, 2365 nt, Artificial Sequence
  KU729218.1 prME-long mRNA Design 3 GC
gggagaaagcuuaccaugcgcaucaucaacgcccggaaggagaagaagcgccggagcgccgacaccuccgugggcaucgucgggcugcuccugaccacggcgauggccgccgaggugacccgccggggcagcgccuacuacauguaccuggaccgcaacgacgccggggaggcgaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucauccgcguggagaacuggaucuuccggaaccccggcuucgcgcuggccgccgccgccaucgcguggcugcucggguccagcaccucccagaaggugaucuaccuggucaugauccugcucaucgccccggccuacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggcguccaucagcgacauggccagcgacucccggugccccacccagggggaggccuaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgcgcgaaggucgagaucacgccgaacagcccccgggccgaggccacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcggcagaccgucguggugcucggcagccaggagggggccguccacaccgcgcuggccggcgcccuggaggccgagauggacggggccaagggccgccucuccagcggccaccugaagugccggcugaagauggacaagcuccgccugaaggggguguccuacagccugugcaccgcggccuucaccuucaccaagauccccgccgagacccuccacggcaccgugacggucgaggugcaguacgccgggaccgacggccccugcaaggugccggcccagauggcggucgacacccagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcagcaccaucgggaaggccuucgaggccaccgugcggggcgccaagcgcauggcgguccugggcgacaccgccugggacuucggguccgugggcggggcccucaacagccugggcaaggggauccaccagaucuucggcgccgcguucaagucccuguucggcgggaugagcugguucucccagauccugaucggcacgcuccugauguggcuggggcucaacaccaagaacggcagcaucucccugaugugccuggcccucgggggcgugcugaucuuccugagcaccgccgucuccgccgacgugggcugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7833 - RNA, 2365 nt, Artificial Sequence
  KU761561.1 prME-long mRNA Design 3 GC
gggagaaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgcccgccggauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7834 - RNA, 2365 nt, Artificial Sequence
  KY317938.1 prME-long mRNA Design 3 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7835 - RNA, 2365 nt, Artificial Sequence
  KY075939.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacucccugcgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7836 - RNA, 2365 nt, Artificial Sequence
  KX806557.2 prME-long mRNA Design 3 GC
gggagaaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggauguuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccuccgacagccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcggguccacgaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7837 - RNA, 2365 nt, Artificial Sequence
  KU870645.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggauccugcggaaccccggguucgcgcuggccgccgccgccaucgcguggcuccugggcagcuccaccagccagaaggugaucuaccuggucaugauccuccugaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgccgaacagcccccgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugccguggcacgccggggccgacacgggcacgccccacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcaccgcggccuucaccuucaccaagauccccgccgagacccugcacgggaccgugacggucgaggugcaguacgccggcaccgacggccccugcaaggugccggcccagauggcggucgacaugcagacccugacccccguggggcggcucaucacggccaaccccgugaucaccgagagcaccgagaacuccaagaugaugcuggagcuggacccgcccuucggcgacagcuacaucgucaucgggaucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7838 - RNA, 2365 nt, Artificial Sequence
  KU729217.2 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucagcaccaccguguccaacauggccgaggugcgcagcuacugcuacgaggcgacgaucuccgacaucgccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgccgucgugcucgggucccaggagggcgcggugcacaccgcccuggccggggcccuggaggccgagauggacggcgcgaagggccgccucagcuccgggcaccugaagugccggcugaagauggacaagcuccgccugaagggcgucagcuacucccugugcaccgccgccuucaccuucaccaagauccccgccgagacccuccacgggaccgugacgguggagguccaguacgccggcaccgacggccccugcaaggugccggcgcagauggccguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgcgaagcgcauggccgugcugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7839 - RNA, 2365 nt, Artificial Sequence
  KU497555.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggacccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggacggugaccgucgaggugcaguacgccggcaccgacggccccugcaaggugccggcccagauggcggucgacaugcagacccugacgcccguggggcggcugaucaccgccaaccccgugaucaccgaguccaccgagaacagcaagaugaugcucgagcuggacccgcccuucggcgacuccuacaucgucaucggggugggcgagaagaagaucacgcaccacuggcaccgcagcggguccaccaucggcaaggccuucgaggccaccgugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacgcuccugauguggcugggccucaacaccaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7840 - RNA, 2365 nt, Artificial Sequence
  KX087101.3 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgagcugcaguacgccggcaccgacggccccugcaaggugccggcccagauggcgguggacaugcagacccugacccccgucgggcggcucaucacggccaaccccgugaucaccgagagcaccgagaacuccaagaugaugcuggagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7841 - RNA, 2365 nt, Artificial Sequence
  KY075932.1 prME-long mRNA Design 3 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcaucgagaacuggaucuuccggaaccccggguucgcgcuggccgccgccgccaucgcguggcugcucggcagcuccaccagccagaaggugaucuaccuggugaugauccugcucaucgccccggccuacuccauccgcugcaucggggucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggucccugggccuggacugcgagccccgcaccggccucgacuucagcgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggucccaggagggcgccgugcacaccgcgcuggccggggcccuggaggccgagauggacggcgccaagggccgccucagcuccgggcaccugaagugccggcugaagauggacaagcuccgccugaagggcgucagcuacucccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgagagcaccgagaacuccaagaugaugcucgagcuggacccgcccuucggcgacagcuacaucgugaucggggucggcgagaagaagaucacccaccacuggcaccgcuccgggagcacgaucggcaaggccuucgaggccaccgugcggggcgccaagcgcauggcggugcugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7842 - RNA, 2365 nt, Artificial Sequence
  KY014317.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaucgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7843 - RNA, 2365 nt, Artificial Sequence
  KU758876.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgugaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagcuucaugugccuggcgcugggcggcgugcucaucuuccuguccaccgccgugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7844 - RNA, 2365 nt, Artificial Sequence
  KU758874.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggcaagcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7845 - RNA, 2365 nt, Artificial Sequence
  KY014314.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggaggcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7846 - RNA, 2365 nt, Artificial Sequence
  KU926310.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcgccgacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7847 - RNA, 2365 nt, Artificial Sequence
  KU761560.1 prME-long mRNA Design 3 GC
gggagaaagcuuaccaugcgcaucaucaacgccggcaaggagaagaagcggcgcggggccgacaccaacgugggcaucgucgggcugcuccugaccacggcgauggccgccgaggugacccggcgcggcagcgccuacuacauguaccuggaccggaacgacgccggggaggcgaucuccuuccccaccacccucggcaugaacaagugcuacauccagaucauggaccugggccacaugugcgacgccacgaugagcuacgagugcccgaugcuggacgaggggguggagcccgacgacgucgacugcuggugcaacaccaccuccaccugggugguguacggcacgugccaccacaagaagggggaggcccgccggagccgccgggccgucacccuccccucccacagcacccgcaagcugcagacccggucccagacguggcuggagagccgcgaguacaccaagcaccucauccggguggagaacuggaucuuccgcaaccccggcuucgcgcuggccgccgccgccaucgcguggcugcucggguccagcaccucccagaaggugaucuaccuggucaugauccugcucaucgccccggccuacagcauccggugcaucggcguguccaaccgcgacuucguggagggcaugagcgggggcaccugggucgacguggugcuggagcacgggggcugcgucacggugauggcccaggacaagcccaccguggacaucgagcuggucaccaccacgguguccaacauggccgaggugcggagcuacugcuacgaggcguccaucagcgacauggccuccgacagccgcugccccacccagggcgaggccuaccucgacaagcagagcgacacccaguacgucugcaagcggacccugguggaccgcggguggggcaacgggugcggccuguucgggaagggcucccucgugacgugcgccaaguucgccugcagcaagaagaugaccggcaaguccauccagcccgagaaccuggaguaccggaucaugcugagcguccacgggucccagcacagcggcaugaucgugaacgacaccgggcacgagaccgacgagaaccgcgcgaaggucgagaucacgccgaacagcccccgcgccgaggccacccucggcggguucggcucccugggccuggacugcgagccccggaccgggcucgacuucuccgaccuguacuaccugaccaugaacaacaagcacuggcucgugcacaaggagugguuccacgacaucccccugccguggcacgccggcgccgacacggggacgccccacuggaacaacaaggaggcgcugguggaguucaaggacgcccacgccaagcgccagaccgucguggugcucggcagccaggagggggccguccacaccgcgcuggccggcgcccuggaggccgagauggacggcgccaaggggcggcucuccagcggccaccugaagugccgccugaagauggacaagcuccggcugaaggggguguccuacagccugugcaccgcggccuucaccuucaccaagauccccgccgagacccuccacggcaccgugacggucgaggugcaguacgccggcaccgacgggcccugcaaggugccggcccagauggcggucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucggcaaggccuucgaggccaccgugcgcggggcccggcgcauggcgguccugggcgacaccgccugggacuucgggagcgugggcggggcccucaacagccugggcaagggcauccaccagaucuucggggccgcguucaagucccuguucggcgggaugagcugguucucccagauccugaucggcacccuccugauguggcuggggcucaacacgaagaacggcagcaucucccugaugugccuggcccucggcggggugcugaucuuccugagcaccgccgucuccgccgacgugggcugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7848 - RNA, 2365 nt, Artificial Sequence
  KY317939.1 prME-long mRNA Design 3 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaaggacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7849 - RNA, 2365 nt, Artificial Sequence
  KY075937.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggucagcgacagccggugccccacccagggcgaggccuaccucgacaagcaguccgacacccaguacgugugcaagcgcacccugguggaccggggcugggggaacggcugcgggcuguucggcaaggggagccucgucacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggucccaggagggcgccgugcacaccgcccuggcgggggcccuggaggccgagauggacggcgccaagggccgccucagcuccgggcaccugaagugccggcugaagauggacaagcuccgccugaagggcgugagcuacucccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgagagcaccgagaacuccaagaugaugcucgagcuggacccgcccuucggcgacagcuacaucgugaucggggugggcgagaagaagaucacccaccacuggcaccgcuccgggagcacgaucggcaaggccuucgaggccaccguccggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7850 - RNA, 2365 nt, Artificial Sequence
  LC191864.1 prME-long mRNA Design 3 GC
gggagaaagcuuaccaugcgcaucaucaacgcccggaaggagaagaagcgccggggcgccgacaccaacguggggaucgucggccugcuccugaccacggcgauggccgccgaggugacccgccgggggagcgccuacuacauguaccuggaccgcaacgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaugaccuccaccugggugguguacgggaccugccaccacaagaagggcgaggcccggcgcagccggcgcgccgucacgcuccccucccacagcacccggaagcugcagacccgcucccagaccuggcuggagagccgggaguacacgaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucaccgugauggcccaggacaagcccacgguggacaucgagcuggucaccaccaccguguccaacauggccgaggugcgcagcuacugcuacgaggcguccaucagcgacauggccuccgacagccggugccccacgcagggcgaggccuaccucgacaagcagagcgacacccaguacgucugcaagcgcacccugguggaccggggcugggggaacggcugcgggcuguucggcaaggggucccucgugaccugcgccaaguucgccugcagcaagaagaugacgggcaaguccauccagcccgagaaccuggaguaccgcaucaugcugagcguccacggcucccagcacagcgggaugaucgugaacgacaccggccacgagaccgacgagaaccgcgcgaaggucgagaucaccccgaacagcccccgggccgaggccacgcucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacaccggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucacguucaccaagauccccgccgagacccuccacgggaccgugaccgucgaggugcaguacgccggcacggacggccccugcaaggugccggcccagauggcggucgacaugcagacccugacccccguggggcggcugaucaccgccaaccccgugaucacggaguccaccgagaacagcaagaugaugcucgagcuggacccgcccuucggcgacuccuacaucgucaucggggugggcgagaagaagaucacccaccacuggcaccgcagcggguccaccaucggcaaggccuucgaggccacggugcggggcgccaagcgcauggcgguccugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacaccaagaacgggagcaucucccugaugugccuggcccucggcggcgugcugaucuuccugagcacggccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7851 - RNA, 2365 nt, Artificial Sequence
  KX447517.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccgcccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagacccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7852 - RNA, 2365 nt, Artificial Sequence
  KU922923.1 prME-long mRNA Design 3 GC
gggagaaagcuuaccaugcgcaucaucaacgcccggaaggagaagaagcgccggggcgccgagaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugccccaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgcccuggccuacuccauccgcugcaucggggugagcaaccgggacuucguggagggcauguccggcgggaccugggucgacguggugcuggagcacggcgggugcgucacggugauggcccaggacaagccgaccguggacaucgagcucgucaccaccacggugagcaacauggccgaggugcgcuccuacugcuacgaggcgagcaucuccgacauggccagcgacagccggugccccacccagggcgaggccuaccuggacaagcaguccgacacccaguacgucugcaagcgcacccugguggaccggggcugggggaacggcugcgggcuguucggcaaggggagccuggugacgugcgccaaguucgccugcuccaagaagaugaccggcaagagcauccagcccgagaaccuggaguaccgcaucaugcucuccguccacggcagccagcacuccgggaugaucgugaacgacaccggccacgagaccgacgagaaccgcgcgaaggucgagaucacgcccaacagcccgcgggccgaggccacccucgggggcuucgggucccugggccucgacugcgagccccgcaccggccuggacuucagcgaccuguacuaccucaccaugaacaacaagcacuggcuggugcacaaggagugguuccacgacaucccccugcccuggcacgccggggccgacacgggcaccccgcacuggaacaacaaggaggcgcucguggaguucaaggacgcccacgccaagcggcagaccgucguggugcuggggucccaggagggcgccguccacaccgcgcuggccggggcccucgaggccgagauggacggcgccaagggccgccugagcuccgggcaccugaagugccggcucaagauggacaagcugcgccugaagggcgugagcuacucccucugcacggcggccuucaccuucaccaagauccccgccgagacccugcacgggaccgugacggucgaggugcaguacgccggcaccgacggccccugcaaggugcccgcccagauggcggucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccucggggacaccgccugggacuucggcagcgucgggggcgcccugaacucccuggggaagggcauccaccagaucuucggcgccgcguucaagagccuguucgggggcauguccugguucagccagauccucaucgggacccugcugauguggcucggccugaacacgaagaacggguccaucagccugaugugccucgcccugggcggcgugcugaucuuccucuccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7853 - RNA, 2365 nt, Artificial Sequence
  KY003156.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucgggaucagcaaccgggacuucguggagggcauguccggcgggaccuggguggacgucgugcuggagcacggcgggugcgugacggucauggcccaggacaagcccaccguggacaucgagcuggugaccaccacggucagcaacauggccgaggugcgcuccuacugcuacgaggcgagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgccugcuccaagaagaugaccggcaagagcauccagcccgagaaccuggaguaccgcaucaugcuguccgugcacggcagccagcacuccgggaugaucgucaacgacaccggccacgagaccgacgagaaccgcgcgaagguggagaucacgccgaacagcccccgggccgaggccacccucgggggcuucgggauccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcgcugguggaguucaaggacgcccacgccaagcggcagaccguggucgugcucgggagccaggagggcgccgugcacaccgcgcuggccggggcccuggaggccgagauggacggcgccaagggccgccucuccagcgggcaccugaagugccggcugaagauggacaagcuccgccugaagggcgucuccuacagccugugcaccgcggccuucaccuucaccaagauccccgccgagacccuccacgggaccgugacgguggagguccaguacgccggcaccgacggccccugcaaggugccggcccagauggcgguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcggguccacgaucggcaaggccuucgaggccaccgugcggggcgccaagcgcauggcggugcugggggacaccgccugggacuucggcagcgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacgucgggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7854 - RNA, 2365 nt, Artificial Sequence
  KU312313.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacacgugcgacgccaccauguccuacgagugcccgaugcuggacgagggcguggagcccgacgacgucgacugcuggugcaacaccaccagcacgugggugguguacgggaccugccaccacaagaagggcgaggcccggcgcucccggcgcgccgucacccuccccagccacuccauccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggugauggcccaggacaagcccaccguggacaucgagcuggucaccaccacggugagcaacauggccgaggugcgcuccuacugcuacgaggcgagcaucuccgacauggccagcgacagccggugccccacccagggcgaggccuaccucgacaagcaguccgacacccaguacgucugcaagcgcacccugguggaccggggcugggggaacggcugcgggcuguucggcaaggggagccucgugacgugcgccaaguucgccugcuccaagaagaugaccggcaagagcauccagcccgagaaccuggaguaccgcaucaugcuguccguccacggcagccagcacuccgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggucccaggagggcgccguccacaccgcgcuggccggggcccuggaggccgagauggacggcgccaagggccgccucagcuccgggcaccugaagugccggcugaagauggacaagcuccgccugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgagagcaccgagaacuccaagaugaugcucgagcuggacccgcccuucggcgacagcuacaucgucaucggggugggcgagaagaagaucacccaccacuggcaccgcuccgggagcacgaucggcaaggccuucgaggccaccgugcggggcgccaagcgcauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacgccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7855 - RNA, 2365 nt, Artificial Sequence
  KY075935.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccagcggucccgccgggccgucacccuccccagccacuccacccgcaagcugcagacccggagccagacguggcuggagucccgcgaguacaccaagcaccucauccggguggagaacuggaucuuccgcaaccccggguucgcgcuggccgccgccgccaucgcguggcugcucggcagcuccaccagccagaaggugaucuaccuggucaugauccugcucaucgccccggccuacuccauccggugcaucggggugagcaaccgcgacuucguggagggcauguccggcgggaccugggucgacguggugcuggagcacggcgggugcgucacggugauggcccaggacaagcccaccguggacaucgagcuggucaccaccacggugagcaacauggccgaggugcgguccuacugcuacgaggcgagcaucuccgacauggccagcgacagccgcugccccacccagggcgaggccuaccucgacaagcaguccgacacccaguacgucugcaagcggacccugguggaccgcggcugggggaacggcugcgggcuguucggcaaggggagccucgugacgugcgccaaguucgccugcuccaagaagaugaccggcaagagcauccagcccgagaaccuggaguaccggaucaugcuguccguccacggcagccagcacuccgggaugaucgugaacgacaccggccacgagaccgacgagaaccgcgcgaaggucgagaucacgccgaacagcccccgcgccgaggccacccucgggggcuucgggucccugggccuggacugcgagccccggaccggccucgacuucagcgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcgccagaccgucguggugcucgggucccaggagggcgccguccacaccgcgcuggccggggcccuggaggccgagauggacggcgccaagggccggcucagcuccgggcaccugaagugccgccugaagauggacaagcuccggcugaagggcgugagcuacucccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcgccugaucacggccaaccccgugaucaccgagagcaccgagaacuccaagaugaugcucgagcuggacccgcccuucggcgacagcuacaucgucaucggggugggcgagaagaagaucacccaccacuggcaccgguccgggagcacgaucggcaaggccuucgaggccaccgugcgcggcgccaagcggauggcgguccugggggacaccgccugggacuucggcagcgucgggggcgcccucaacucccuggggaagggcauccaccagaucuucggcgccgcguucaagagccuguucgggggcauguccugguucagccagauccugaucgggacccuccugauguggcugggccucaacacgaagaacggguccaucagccugaugugccuggcccucggcggcgugcugaucuuccuguccaccgccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7856 - RNA, 2365 nt, Artificial Sequence
  KY014320.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcaggcgcgcagccagaccuggcuggagucccgggaguacacgaagcaccucauccgcguggagaacuggaucuuccggaaccccggguucgcccuggccgccgccgcgaucgccuggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucaccgugauggcccaggacaagcccacgguggacaucgagcuggucaccaccaccgugagcaacauggcggaggugcgcuccuacugcuacgaggccagcaucuccgacauggccagcgacagccggugccccacgcagggcgaggccuaccucgacaagcaguccgacacccaguacgucugcaagcgcacccugguggaccggggcugggggaacggcugcgggcuguucggcaaggggagccucgugaccugcgccaaguucgcgugcuccaagaagaugacgggcaagagcauccagcccgagaaccuggaguaccgcaucaugcuguccguccacggcagccagcacuccgggaugaucgugaacgacaccggccacgagaccgacgagaaccgcgccaaggucgagaucaccccgaacagcccccgggccgaggccacgcucgggggcuucgggucccugggccuggacugcgagccccgcaccggccucgacuucagcgaccuguacuaccugaccaugaacaacaagcacuggcucgugcacaaggagugguuccacgacaucccccugccguggcacgccggggcggacaccggcacgccccacuggaacaacaaggaggcccugguggaguucaaggacgcccacgccaagcggcagaccgucguggugcucgggucccaggagggcgcgguccacaccgcccuggccggggcccuggaggccgagauggacggcgcgaagggccgccucagcuccgggcaccugaagugccggcugaagauggacaagcuccgccugaagggcgugagcuacucccugugcaccgccgccuucacguucaccaagauccccgccgagacccuccacgggaccgugaccgucgaggugcaguacgccggcacggacggccccugcaaggugccggcgcagauggccgucgacaugcagacccugacccccguggggcggcugaucaccgccaaccccgugaucacggagagcaccgagaacuccaagaugaugcucgagcuggacccgcccuucggcgacagcuacaucgucaucggggugggcgagaagaagaucacccaccacuggcaccgcuccgggagcaccaucggcaaggccuucgaggccacggugcggggcgcgaagcgcauggccguccugggggacaccgccugggacuucggcagcgucgggggcgcccucaacucccuggggaagggcauccaccagaucuucggcgcggccuucaagagccuguucgggggcauguccugguucagccagauccugaucgggacccuccugauguggcugggccucaacaccaagaacggguccaucagccugaugugccuggcccucggcggcgugcugaucuuccuguccacggccgugagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7857 - RNA, 2365 nt, Artificial Sequence
  KX827309.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcagcgacgccggcgaggcgaucuccuuccccaccacccucgggaugaacaagugcuacauccagaucauggaccugggccacaugugcgacgccacgaugagcuacgagugcccgaugcuggacgagggcguggagcccgacgacgucgacugcuggugcaacaccaccuccaccugggugguguacgggacgugccaccacaagaagggcgaggcccggcgcagccggcgcgccgucacccuccccucccacagcacccggaagcugcagacccgcucccagacguggcuggagagccgggaguacaccaagcaccucauccgcguggagaacuggaucuuccggaaccccggguucgcgcuggccgccgccgccaucgcguggcugcucggcuccagcaccucccagaaggugaucuaccuggucaugauccugcucaucgccccggccuacagcauccgcugcaucgggguguccaaccgggacuucguggagggcaugagcggcgggaccugggucgacguggugcuggagcacggcgggugcgucacggugauggcccaggacaagcccaccguggacaucgagcuggucaccaccacgguguccaacauggccgaggugcgcagcuacugcuacgaggcguccaucagcgacauggccagcgacucccggugccccacccagggcgaggccuaccucgacaagcagagcgacacccaguacgucugcaagcgcacccugguggaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgcgaaggucgagaucacgccgaacagcccccgggccgaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcgcugguggaguucaaggacgcccacgccaagcggcagaccgucguggugcucgggagccaggagggcgccguccacaccgcgcuggccggggcccuggaggccgagauggacggcgccaagggccgccucuccagcgggcaccugaagugccggcugaagauggacaagcuccgccugaagggcguguccuacagccugugcaccgcggccuucaccuucaccaagauccccgccgagacccuccacgggaccgugacggucgaggugcaguacgccggcaccgacggccccugcaaggugccggcccagauggcggucgacaugcagacccugacccccguggggcggcugaucacggccaaccccgugaucaccgaguccaccgagaacagcaagaugaugcucgagcuggacccgcccuucggcgacuccuacaucgucaucggggugggcgagaagaagaucacccaccacuggcaccgcagcgggagcacgaucggcaaggccuucgaggccaccgugcggggcgccaagcgcauggcgguccugggggacaccgccugggacuucggcuccgucgggggcgcccucaacagccuggggaagggcauccaccagaucuucggcgccgcguucaagucccuguucgggggcaugagcugguucucccagauccugaucgggacccuccugauguggcugggccucaacacgaagaacgggagcaucucccugaugugccuggcccucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7858 - RNA, 2365 nt, Artificial Sequence
  KU681081.3 prME-long mRNA Design 3 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacaccggggccgacaccggcacgccccacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuccagcgggcaccugaagugccggcugaagauggacaagcuccgccugaagggcguguccuacagccugugcaccgccgccuucaccuucaccaagauccccgcggagacgcuccacgggaccgugaccgucgaggugcaguacgccggcaccgacggccccugcaaggugccggcccagauggccgucgacaugcagacgcugacccccguggggcggcugaucaccgccaaccccgugaucaccgagggcacggagaacuccaagaugaugcucgagcuggacccgcccuucggggacagcuacaucgucaucggcgugggggagaagaagaucacccaccacuggcaccgcuccggcagcaccaucggcaaggcguucgaggccaccgugcgcggggccaagcggauggccguccugggcgacacggccugggacuucgggagcgugggcggggugcucaacucccugggcaagggcauccaccagaucuucggggcggccuucaagagccuguucggcgggauguccugguucagccagauccugaucggcacccuccugauguggcuggggcucaacaccaagaacggcuccaucagccugaugugccuggcccucggcgggguccugaucuuccuguccaccgccgugagcgcggacgugggcugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7859 - RNA, 2365 nt, Artificial Sequence
  KU744693.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccgccgaggugacccgccggggguccgccuacuacauguaccuggaccgcaacgacgccggcgaggcgaucagcuuccccaccacccucgggaugaacaagugcuacauccagaucauggaccugggccacaugugcgacgccacgauguccuacgagugcccgaugcuggacgagggcguggagcccgacgacgucgacugcuggugcaacaccaccagcaccugggugguguacgggacgugccaccacaagaagggcgaggcccggcgcucccggcgcgccgucacccuccccagccacuccacccggaagcugcagacccgcagccagacguggcuggagucccgggaguacaccaagcaccucauccgcguggagaacuggaucuuccggaaccccggguucgcgcuggccgccgccgccaucgcguggcugcucggcagcuccaccagccagaaggugaucuaccuggucaugauccugcucaucgccccggccuacuccauccgcugcaucggggugagcaaccgggacuucguggagggcauguccggcgggaccugggucgacguggugcuggagcacggcgggugcgucacggccauggcccaggacaagcccaccguggacaucgagcuggugaccaccacggucagcaacauggcggaggugcgcuccuacugcuacgaggccagcaucuccgacauggccagcgacagccggugccccacccagggcgaggccuaccucgacaagcaguccgacacccaguacgugugcaagcgcacccuggucgaccggggcugggggaacggcugcgggcuguucggcaaggggagccucgugacgugcgccaaguucgcgugcuccaagaagaugaccggcaagagcauccagcccgagaaccuggaguaccgcaucaugcuguccgugcacggcagccagcacuccgggaugcucgucaacgacaccggccacgagaccgacgagaaccgcgccaagguggagaucacgccgaacagcccccgggccgaggccacccucgggggcuucgggucccugggccuggacugcgagccccgcaccggccuggacuucagcgaccuguacuaccucaccaugaacaacaagcacuggcuggcccacaaggagugguuccacgacaucccccugccguggcacgcgggggccgccacgggcacgccccacuggaacaacaaggaggcccucgucgaguucaaggacgcgcacgccaagcggcagaccguggugguccuggggucccaggagggcgccgugcacaccgcccuggccggggcgcucgaggccgagauggacggcgccaagggccgccugagcuccgggcaccugaagugccggcucaagauggacaagcugcgccugaagggcgugagcuacucccucugcaccgccgccuucaccuucaccaagauccccgcggagaccgucgacgggaccgugacgguggagggccaguacggcgggaccgacggccccugcaaggucccggcccagauggccguggacaugcagacccugacccccguggggcggcugaucacggccaaccccgucaucaccgagagcaccgagaacuccaagaugaugcucgagcuggacccgcccuucggcgacagcuacaucgugaucggggugggcgagaagaagaucacccaccacuggcaccgcuccggcagcacgaucgggaaggccuucgaggcgaccguccggggcgccaagcgcauggccgugcugggggacaccgccugggacuucggcagcgucgggggcgcgcucaacucccugggcaaggggauccaccagaucaucggcgccgccuucaagagccuguucgggggcauguccugguucagccagauccugaucgggacccuccugauguggcugggccucaacacgaagaacggcuccaucagccugaugugccuggcccucgggggcgugcugaucuuccuguccaccgccgugagcgggggcguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7860 - RNA, 2365 nt, Artificial Sequence
  KY328290.1 prME-long mRNA Design 3 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucuccaagauccccgccgagacccuccacgggaccgugacggaggagguccaguacgccggcaccgacggccccugcaaggugccggcccagauggccguggacaugcagacccugacccccgucgggcggcugaucacggcgaaccccgugaucaccgagagcaccgagaacuccaagaugaugcucgagcuggacccgcccuucggcgacagcuacaucgugaucggggucggcgagaagaagaucacccaccacuggcaccgcagcggguccacgaucggcaaggccuucgaggccaccgugcggggcgccaagcgcauggccgugcugggggacaccgcgugggacuucggcagcgucgggggcgcccucaacucccuggggaagggcauccaccagaucuucggcgccgccuucaagagccuguucgggggcauguccugguucagccagauccugaucgggacccuccugauguggcugggccucaacacgaagaacggguccaucagccugaugugccuggcgcucggcggcgugcugaucuuccuguccaccgccgugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7861 - RNA, 2365 nt, Artificial Sequence
  KX694532.2 prME-long mRNA Design 3 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccugaugugccuggcgcucggcggcgugcugaucuuccugagcaccgccguguccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7862 - RNA, 2365 nt, Artificial Sequence
  KU955593.1 prME-long mRNA Design 3 GC
gggagaaagcuuaccaugcgcaucaucaacgcccggaaggagaagaagcgccggggcaccgacaccagcguggggaucgucggccugcuccugacgaccgccauggcgguggaggugacccgccgggggaacgccuacuacauguaccuggaccgcuccgacgccggcgaggccaucagcuuccccaccacgauggggaugaacaagugcuacauccagaucauggaccucggccacaugugcgacgccaccauguccuacgagugcccgaugcuggacgagggcgucgagcccgacgacguggacugcuggugcaacaccaccagcacguggguggucuacgggaccugccaccacaagaagggcgaggcgcggcgcucccggcgcgccgugacccugcccagccacuccacccggaagcuccagacgcgcagccagaccuggcuggagucccgggaguacaccaagcaccugauccgcguggagaacuggaucuuccggaaccccggguucgcccucgccgcggccgccaucgccuggcugcugggcagcuccaccagccagaaggucaucuaccucgugaugauccugcugaucgccccggcguacuccauccgcugcaucggggugagcaaccgggacuucgucgagggcauguccggcgggacguggguggacgugguccucgagcacggcgggugcgugaccgugauggcccaggacaagcccaccgucgacaucgagcuggugaccacgaccgugagcaacauggccgagguccgcuccuacugcuacgaggccagcaucuccgacauggccagcgacagccggugccccacccagggcgaggcguaccuggacaagcaguccgacacccaguacgugugcaagcgcacgcucguggaccggggcugggggaacggcugcgggcuguucggcaaggggagccuggugaccugcgccaaguucgccugcuccaagaagaugaccggcaagagcauccagcccgagaaccucgaguaccgcaucaugcuguccgugcacggcagccagcacuccgggaugaucgucaacgacaccggccacgagacggacgagaaccgcgccaagguggagaucaccccgaacagcccccgggccgaggcgacccucgggggcuucgggucccugggccuggacugcgagccccgcaccggccuggacuucagcgaccucuacuaccugacgaugaacaacaagcacuggcuggugcacaaggagugguuccacgacaucccccucccguggcacgccggggccgacaccggcacgccccacuggaacaacaaggaggcccuggucgaguucaaggacgcccacgcgaagcggcagaccguggugguccuggggucccaggagggcgccgugcacaccgcccucgccggggcgcuggaggccgagauggacggcgccaagggccgccugagcuccgggcaccucaagugccggcugaagauggacaagcugcgccucaagggcgugagcuacucccugugcaccgccgccuucaccuucaccaagauccccgcggagacccugcacgggacggucaccguggaggugcaguacgccggcaccgacggccccugcaaggucccggcccagauggccguggacaugcagacccucacgcccguggggcggcugaucaccgccaaccccgucaucaccgagagcaccgagaacuccaagaugaugcuggagcucgacccgcccuucggcgacagcuacaucgugaucggggugggcgagaagaagaucacgcaccacuggcaccgcuccgggagcaccaucggcaaggcguucgaggccaccguccggggcgccaagcgcauggccgugcugggggacaccgccugggacuucggcagcgucgggggcgcgcugaacucccucgggaagggcauccaccagaucuucggcgccgccuucaagagccuguucgggggcauguccugguucagccagauccugaucgggacgcugcucgucuggcugggccugaacaccaagaacggguccaucagccucaugugccuggcccugggcggcgugcucaucuuccuguccaccgcggugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7863 - RNA, 2365 nt, Artificial Sequence
  KY272987.1 prME-long mRNA Design 3 GC
gggagaaagcuuaccaugcgcaucaucaacgcccggaaggagaagaagcgccggggcaccgacaccagcguggggaucgucggccugcuccugacgaccgccauggcggccgaggugacccgccggggguccgccuacuacauguaccuggaccgcagcgacgccggcgaggccaucuccuuccccaccacgcucgggaugaacaagugcuacauccagaucauggaccugggccacaugugcgacgcgaccaugagcuacgagugcccgaugcuggacgagggcguggagcccgacgacgucgacugcuggugcaacaccaccuccacgugggugguguacgggaccugccaccacaagaagggcgaggcccggcgcagccggcgcgccgucacccuccccucccacagcacccggaagcugcagacgcgcucccagaccuggcuggagagccgggaguacaccaagcaccucauccgcguggagaacuggaucuuccggaaccccggguucgcccuggcggccgccgccaucgccuggcugcucggcuccagcaccucccagaaggugaucuaccuggucaugauccugcucaucgcgccggccuacagcauccgcugcaucgggguguccaaccgggacuucguggagggcaugagcggcgggacgugggucgacguggugcuggagcacggcgggugcgucaccgugauggcccaggacaagcccaccguggacaucgagcuggucaccacgaccguguccaacauggccgaggugcgcagcuacugcuacgaggccuccaucagcgacauggcgagcgacucccggugccccacccagggcgaggccuaccucgacaagcagagcgacacccaguacgucugcaagcgcacgcugguggaccggggcugggggaacggcugcgggcuguucggcaaggggucccucgugaccugcgccaaguucgccugcagcaagaagaugaccggcaaguccauccagcccgagaaccuggaguaccgcaucaugcugagcguccacggcucccagcacagcgggaugaucgugaacgacaccggccacgagacggacgagaaccgcgccaaggucgagaucaccccgaacagcccccgggcggaggccacccucgggggcuucgggucccugggccuggacugcgagccccgcaccggccucgacuucuccgaccuguacuaccugacgaugaacaacaagcacuggcucgugcacaaggagugguuccacgacaucccccugccguggcacgccggggccgacaccggcacgccccacuggaacaacaaggaggcccugguggaguucaaggacgcgcacgccaagcggcagaccgucguggugcucgggagccaggagggcgccguccacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggacggugaccgucgaggugcaguacgccggcaccgacggccccugcaaggugccggcccagauggccgucgacaugcagacccugacgcccguggggcggcugaucaccgcgaaccccgugaucaccgaguccaccgagaacagcaagaugaugcucgagcuggacccgcccuucggcgacuccuacaucgucaucggggugggcgagaagaagaucacgcaccacuggcaccgcagcgggagcaccaucggcaaggccuucgaggccaccgugcggggcgccaagcgcauggccguccugggggacaccgcgugggacuucggcuccgucgggggcgcccucaacagccuggggaagggcauccaccagaucuucggcgccgccuucaagucccuguucgggggcaugagcugguucucccagauccugaucgggacgcuccugauguggcugggccucaacaccaagaacgggagcaucucccuggugugccuggcgcucggcggcgugcugaucuuccugagcaccgccguguccgccgacguggggugcagcgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7864 - RNA, 2365 nt, Artificial Sequence
  EU545988.1 prME-long mRNA Design 3 GC
gggagaaagcuuaccaugcgcaucaucaacgcccggaaggagaagaagcgccggggcaccgacaccagcguggggaucgucggccugcuccugacgaccgccauggcgguggaggugacccgccggggguccgccuacuacauguaccuggaccgcagcgacgccggcgaggccaucuccuuccccaccacgcucgggaugaacaagugcuacauccagaucauggaccugggccacaugugcgacgccaccaugagcuacgagugcccgaugcuggacgagggcgucgagcccgacgacguggacugcuggugcaacaccaccuccacguggguggucuacgggaccugccaccacaagaagggcgaggcgcggcgcagccggcgcgccgugacccuccccucccacagcacccggaagcugcagacgcgcucccagaccuggcuggagagccgggaguacaccaagcaccucauccgcguggagaacuggaucuuccggaaccccggguucgcccuggccgcggccgccaucgccuggcugcucggcuccagcaccucccagaaggucaucuaccuggugaugauccugcucaucgccccggcguacagcauccgcugcaucgggguguccaaccgggacuucgucgagggcaugagcggcgggacguggguggacgugguccuggagcacggcgggugcgugaccgugauggcccaggacaagcccgccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucgccugcagcaagaagaugaccggcaaguccauccagcccgagaaccuggaguaccgcaucaugcugagcgugcacggcucccagcacagcgggaugaucgucaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucgugcacaaggagugguuccacgacaucccccugccguggcacgccggggccgacacgggcacgccccacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuccagcgggcaccugaagugccggcugaagauggacaagcuccgccugaagggcguguccuacagccugugcaccgccgcguucaccuucaccaagauccccgccgagacccuccacgggaccgucacgguggaggugcaguacgccggcaccgacggccccugcaaggucccggcccagauggccguggacaugcagacccugacccccguggggcggcugaucacggcgaaccccgucaucaccgaguccaccgagaacagcaagaugaugcucgagcuggacccgcccuucggcgacuccuacaucgugaucggggugggcgagaagaagaucacccaccacuggcaccgcagcgggagcacgaucggcaaggccuucgaggccaccguccggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccguguccgccgacgucgggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7865 - RNA, 2365 nt, Artificial Sequence
  KU681082.3 prME-long mRNA Design 3 GC
gggagaaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucgggaugaacaagugcuacauccagaucauggaccugggccacaugugcgacgcgacgaugagcuacgagugcccgaugcuggacgagggcgucgagcccgacgacguggacugcuggugcaacaccaccuccaccuggguggucuacgggacgugccaccacaagaagggcgaggcccggcgcagccggcgcgccgugacccuccccucccacagcacccggaagcugcagacccgcucccagacguggcuggagagccgggaguacaccaagcaccucauccgcguggagaacuggaucuuccggaaccccggguucgcccuggcggccgccgucaucgccuggcugcucggcuccagcaccucccagaaggugaucuaccuggugaugauccugcucaucgccccggcguacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggccagcgacucccggugccccacccagggcgaggcguaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggccgaggcgacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuccagcgggcaccugaagugccggcugaagauggacaagcuccgccugaagggcgucuccuacagccugugcaccgccgccuucaccuucaccaagauccccgcggagacccuccacgggaccgugacgguggagguccaguacgccggcaccgacggccccugcaaggugccggcccagauggccguggacaugcagacccugacccccgucgggcggcugaucacggccaaccccgugaucaccgaguccaccgagaacagcaagaugaugcucgagcuggacccgcccuucggcgacuccuacaucgugaucggggucggcgagaagaagaucacccaccacuggcaccgcagcgggagcacgaucggcaaggcguucgaggccaccgugcggggcgccaagcgcauggccgugcugggggacaccgccugggacuucggcuccgucgggggcgcgcucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcccucggcggcgugcugaucuuccugagcaccgcggucuccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7866 - RNA, 2365 nt, Artificial Sequence
  KX601167.1 prME-long mRNA Design 3 GC
gggagaaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcgaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggagaucacgccgaacagcccccgggcggaggccacccucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacacgggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucaccuucaccaagauccccgccgagacccuccacgggaccgugacgguggagguccaguacgccggcaccgacggccccugcaaggugccggcccagauggccguggacaugcagacccugacccccgucgggcggcugaucacggcgaaccccgugaucaccgaguccaccgagaacagcaagaugaugcucgagcuggacccgcccuucggcgacuccuacaucgugaucggggucggcgacaagaagaucacccaccacugguaccgcagcgggagcacgaucggcaaggccuucgaggccaccgugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacacgaagaacgggagcaucucccugaccugccuggcgcucggcggcgugcugaucuuccugagcaccgccgucuccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7867 - RNA, 2365 nt, Artificial Sequence
  KX694533.2 prME-long mRNA Design 3 GC
gggagaaagcuuaccaugcgcaucaucaacgcccggaaggagaagaagcgccggggcgccgacaccagcguggggaucgucggccugcuccugaccacggcgauggccguggaggugacccgccggggguccgccuacuacauguaccuggaccgcagcgacgccggcaaggccaucuccuuccccaccacccucggggucaacaagugcuacauccagaucauggaccugggccacaugugcgacgcgacgaugagcuacgagugcccgaugcuggacgagggcguggagcccgacgacguggacugcuggugcaacaccaccuccaccugggucguguacgggacgugccaccacaagaagggcgaggcccggcgcagccggcgcgccgugacccuccccucccacagcacccggaagcugcagacccgcucccagacguggcuggagagccgggaguacaccaagcaccucauccgcgucgagaacuggaucuuccggaaccccggguucgcccuggcggccgccgccaucgccuggcugcucggcuccagcaccucccagaaggugaucuaccuggugaugauccugcucaucgcgccggccuacagcauccgcugcaucggggucuccaaccgggacuucguggagggcaugagcggcgggaccuggguggacgucgugcuggagcacggcgggugcgugacggucauggcccaggacaagcccaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucgccugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggagaucaccccgaacagcccccgggcggaggccacgcucgggggcuucgggucccugggccuggacugcgagccccgcaccggccucgacuucuccgaccuguacuaccugaccaugaacaacaagcacuggcucguccacaaggagugguuccacgacaucccccugccguggcacgccggggccgacaccggcacgccccacuggaacaacaaggaggcccugguggaguucaaggacgcgcacgccaagcggcagaccguggucgugcucgggagccaggagggcgccgugcacaccgcccuggcgggggcccuggaggccgagauggacggcgccaagggccgccucuccagcgggcaccugaagugccggcugaagauggacaagcuccgccugaagggcgucuccuacagccugugcaccgccgcguucacguucaccaagauccccgccgagacccuccacgggaccgugaccguggagguccaguacgccggcacggacggccccugcaaggugccggcccagauggccguggacaugcagacccugacccccgucgggcggcugaucaccgcgaaccccgugaucacggaguccaccgagaacagcaagaugaugcucgagcuggacccgcccuucggcgacuccuacaucgugaucggggucggcgacaagaagaucacccaccacuggcaccgcagcgggagcaccaucggcaaggccuucgaggccacggugcggggcgccaagcgcauggccgugcugggggacaccgcgugggacuucggcuccgucgggggcgcccucaacagccuggggaagggcauccaccagaucuucggcgccgccuucaagucccuguucgggggcaugagcugguucucccagauccugaucgggacccuccugguguggcugggccucaacaccaagaacgggagcaucucccugacgugccuggcgcucggcggcgugcugaucuuccugagcaccgccgucuccgccgacguggggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7868 - RNA, 2365 nt, Artificial Sequence
  KY288905.1 prME-long mRNA Design 3 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucacccugguggccgucgccaucgccuggcugcucggcuccagcaccucccagaaggugaucuaccuggugaugauccugcucaucgcccccgcguacagcauccgcugcaucggggucuccaaccgggacuucguggagggcaugagcggcgggacguggguggacgucgugcuggagcacggcgggugcgugaccgucauggcccaggacaagccgaccguggacaucgagcuggugaccacgaccgucuccaacauggccgaggugcgcagcuacugcuacgaggccuccaucagcgacauggccagcgacucccggugccccacccagggcgaggcguaccucgacaagcagagcgacacccaguacgugugcaagcgcacgcuggucgaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggccacccucgggggcuucgggagccugggccuggacugcgagccccgcacgggccucgacuucuccgaccuguacuaccugaccaugaacaacaagcacuggcucgugcacaaggagugguuccacgacaucccccugcccuggcacgcgggggccgacaccggcaccccgcacuggaacaacaaggaggcccugguggaguucaaggacgcccacgccaagcggcagacggucguggugcucgggagccaggagggcgcgguccacaccgcccuggccggggcccuggaggcggagauggacggcgccaagggccgccucuucuccgggcaccugaagugccggcugaagauggacaagcuccgccugaagggcgugagcuacucccugugcaccgccgccuucaccuucaccaaggugcccgccgagacgcuccacgggaccgucaccguggaggugcaguacgcgggcaccgacggccccugcaagguccccgcccagauggccguggacaugcagacgcugaccccgguggggcggcugaucaccgccaaccccgucaucaccgagagcacggagaacuccaagaugaugcucgagcuggacccgcccuucggcgacagcuacaucgugaucggggugggcgacaagaagaucacccaccacuggcaccgcuccgggagcaccaucggcaaggccuucgaggcgaccguccggggcgccaagcgcauggccgugcugggggacacggccugggacuucggcagcgucgggggcguguucaacucccucgggaagggcauccaccagaucuucggcgccgcguucaagagccuguucgggggcauguccugguucagccagauccugaucgggacccugcucguguggcugggccugaacaccaagaacggguccaucagccugaccugccucgcccugggcggcgugaugaucuuccucuccacggccgucagcgccgacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7869 - RNA, 2365 nt, Artificial Sequence
  KF268950.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaaggucgaggugacccccaacuccccgcgggcggaggccacgcucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacaccggcacgccgcacuggaacaacaaggaggcccuggucgaguucaaggacgcgcacgccaagcggcagaccguggugguccucgggagccaggagggcgccgugcacaccgcccuggcgggggcccuggaggccgagauggacggcgccaagggccgccucuucuccgggcaccugaagugccggcugaagauggacaagcuccgccugaagggcgugagcuacucccugugcaccgccgcguucacguucaccaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcgugcaccagaucuucggcgccgccuucaagagccuguucgggggcauguccugguucagccagauccugaucgggacccugcucgucuggcugggccugaacaccaagaacggguccaucagccucacgugccuggcccugggcggcgugaugaucuuccucuccaccgcggugagcgccgacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7870 - RNA, 2365 nt, Artificial Sequence
  KF383121.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagcccgacgacguggacugcuggugcaacaccaccuccaccugggucguguacgggacgugccaccacaagaagggcgaggcccgccggagccgccgggcggugacccuccccucccacagcacccgcaagcugcagacccggucccagacguggcuggagagccgcgaguacaccaagcaccucaucaaggucgagaacuggaucuuccggaaccccggguucgcccugguggccguggccaucgccuggcugcucggcuccagcaccucccagaaggucaucuaccuggugaugauccugcucaucgcgcccgccuacagcauccgcugcaucgggguguccaaccgggacuucgucgagggcaugagcggcgggaccuggguggacgugguccuggagcacggcgggugcgugacggugauggcccaggacaagccgaccgucgacaucgagcuggugaccaccacgguguccaacauggccgagguccgcagcuacugcuacgaggccuccaucagcgacauggcgagcgacucccggugccccacccagggcgaggccuaccucgacaagcagagcgacacccaguacgugugcaagcgcacccugguggaccggggcugggggaacggcugcgggcuguucggcaaggggucccucgucacgugcgccaaguucacgugcagcaagaagaugaccggcaaguccauccagcccgagaaccuggaguaccgcaucaugcugagcgugcacggcucccagcacagcgggaugaucgucaacgacaucggccacgagaccgacgagaaccgcgccaagguggaggugacccccaacuccccgcgggccgaggcgacccucgggggcuucgggagccugggccuggacugcgagccccgcaccggccucgacuucuccgaccuguacuaccugaccaugaacaacaagcacuggcucguccacaaggagugguuccacgacaucccccugcccuggcacgccggggccgacacgggcaccccgcacuggaacaacaaggaggcccugguggaguucaaggacgcccacgcgaagcggcagaccguggucgugcucgggagccaggagggcgccgugcacaccgcccuggccggggcgcuggaggccgagauggacggcgccaagggccgccucuucuccgggcaccugaagugccggcugaagauggacaagcuccgccugaagggcgucagcuacucccugugcacggccgccuucaccuucaccaaggugcccgcggagacccuccacgggaccgugacggucgaggugcaguacgccggcaccgacggccccugcaaggugcccgcccagauggccgucgacaugcagacccugaccccgguggggcggcugaucacggccaaccccgugaucaccgagagcaccgagaacuccaagaugaugcucgagcuggacccgcccuucggcgacagcuacaucgucaucggggugggcgacaagaagaucacccaccacuggcaccgcuccgggagcacgaucggcaaggcguucgaggccaccgugcggggcgccaagcgcauggccguccugggggacaccgccugggacuucggcagcgucgggggcguguucaacucccucgggaagggcauccaccagaucuucggcgcggccuucaagagccuguucgggggcauguccugguucagccagauccugaucgggacccugcucguguggcugggccugaacacgaagaacggguccaucagccugaccugccucgcccugggcggcgugaugaucuuccucuccaccgccgugagcgcggacgucgggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7871 - RNA, 2347 nt, Artificial Sequence
  KF268949.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaaccucggggugaacaagugccacguccagaucauggaccugggccacaugugcgacgccaccaugagcuacgagugccccaugcuggacgagggcguggagcccgacgacguggacugcuggugcaacacgaccuccaccugggucguguacgggaccugccaccacaagaagggcgaggcccgccggagccgccgggcggugacgcuccccucccacagcacccgcaagcugcagacccggucccagaccuggcuggagagccgcgaguacacgaagcaccucaucaaggucgagaacuggaucuuccggaaccccggguucgcccuggccgccguggccaucgcguggcugcucggcuccagcaccucccagaaggugaucuaccuggucaugauccugcucaucgcccccgccuacagcauccgcugcaucgggguguccaaccgggacuucguggagggcaugagcggcgggaccugggucgacguggugcuggagcacggcgggugcgucaccgugauggcccaggacaagccgacgguggacaucgagcuggucaccaccaccguguccaacauggccgaggugcgcagcuacugcuacgaggcguccaucagcgacauggccagcgacucccggugccccacgcagggcgaggccuaccucgacaagcagagcgacacccaguacgucugcaagcgcacccugguggaccggggcugggggaacggcugcgggcuguucggcaaggggucccucgugaccugcgccaaguucacgugcagcaagaagaugaccggcaaguccauccagcccgagaaccuggaguaccgcaucaugcugagcguccacggcucccagcacagcgggaugaucgugaacgacgagaaccgcgccaaggucgaggugacccccaacuccccgcgggcggaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcccuggucgaguucaaggacgcgcacgccaagcggcagacgguggugguccucggcagccaggagggggccgugcacaccgcccuggcgggcgcccuggaggccgagauggacggggccaagggccgccucuucuccggccaccugaagugccggcugaagauggacaagcuccgccugaagggggugagcuacucccugugcaccgccgcguucaccuucacgaagguccccgccgagacccuccacggcaccgugaccguggagguccaguacgccgggaccgacggccccugcaaggugcccgcccagauggccguggacaugcagacgcugaccccggucggccggcugaucaccgcgaaccccgugaucaccgagagcacggagaacuccaagaugaugcucgagcuggacccgcccuucggggacagcuacaucgugaucggcgucggggacaagaagaucacccaccacuggcaccgcuccggcagcaccaucgggaaggccuucgaggccaccgugcggggcgccaagcgcauggccgugcugggcgacacggcgugggacuucgggagcgucggcgggguguucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgucaugaucuuccucuccacggcggugagcgccgacgugggcugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7872 - RNA, 2365 nt, Artificial Sequence
  KU955595.1 prME-long mRNA Design 3 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaccggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugacgaugaacaacaagcacuggcucgugcacaaggagugguuccacgacaucccccugcccuggcacgccggggccgacaccggcaccccgcacuggaacaacaaggaggcccugguggaguucaaggacgcccacgcgaagcggcagaccgucguggugcucgggagccaggagggcgccguccacacggcccuggccggggcgcuggaggccgagauggacggcgccaagggccgccucuucuccgggcaccugaagugccggcugaagauggacaagcuccgccugaagggcgugagcuacucccugugcaccgccgccuucaccuucaccaaggugcccgcggagacccuccacgggacggucaccguggaggugcaguacgccggcaccgacggccccugcaagguccccgcccagauggccguggacaugcagacccugacgccgguggggcggcugaucaccgccaaccccgucaucaccgagagcaccgagaacuccaagaugaugcucgagcuggacccgcccuucggcgacagcuacaucgugaucggggugggcgacaagaagaucacgcaccacuggcaccgcuccgggagcaccaucggcaaggcguucgaggccaccguccggggcgccaagcgcauggccgugcugggggacaccgccugggacuucggcagcgucgggggcguguucaacucccucgggaagggcauccaccagaucuucggcgcggccuucaagagccuguucgggggcauguccugguucagccagauccugaucgggacgcugcucguguggcugggccugaacaccaagaacggguccaucagccugaccugccucgcccugggcggcgugaugaucuuccucuccaccgccgucagcgcggacguggggugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7873 - RNA, 2365 nt, Artificial Sequence
  KF383116.1 prME-long mRNA Design 3 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccagcacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacaucggccacgagaccgacgagaaccgcgccaagguggaggucacccccaacuccccgcgggccgaggcgacccucgggggcuucgggagccugggccuggacugcgagccccgcaccggccucgacuucuccgaccuguacuaccugaccaugaacaacaagcacuggcucgugcacaaggagugguuccacgacaucccccugcccuggcacgccggggccgacacgggcaccccgcacuggaacaacaaggaggcccugguggaguucaaggacgcccacgcgaagcggcagaccgucguggugcucgggagccaggagggcgccguccacaccgcccuggccggggcgcuggaggccgagauggacggcgccaagggccgccucuucuccgggcaccugaagugccggcugaagauggacaagcuccgccugaagggcgugagcuacucccugugcacggccgugugcaccgccgcgaagguccccgccgagacccuccacgggaccgugaccguggagguccaguacgccggcacggacggccccugcaaggugcccgcccagauggccguggacaugcagacccugaccccggucgggcggcugaucaccgcgaaccccgugaucacggagagcaccgagaacuccaagaugaugcucgagcuggacccgcccuucggcgacagcuacaucgugaucggggucggcgacaagaagaucacccaccacuggcaccgcuccgggagcaccaucggcaaggccuucgaggccacggugcggggcgccaagcgcauggccgugcugggggacaccgcgugggacuucggcagcgucgggggcguguucaacucccucgggaagggcauccaccagaucuucggcgccgccuucaagagccuguucgggggcauguccugguucagccagauccugaucgggacccugcucguguggcugggccugaacaccaagaacggguccaucagccucacgugccuggcccugggcggcgucaugaucuuccucuccaccgcggugagcgccgacguggggugcuccgucgacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7874 - RNA, 2347 nt, Artificial Sequence
  KU963574.2 prME-long mRNA Design 3 GC
gggagaaagcuuaccaugcgcaucaucaacgcccggaaggagcgcaagcggcgcggcgccgacgcgagcaucgggaucgugucccugcuccugaccaccgucauggccgccgagaucacgcggcgcggcagcgccuacuacauguaccuggaccgguccgacgccgggaaggcgaucagcuucgugaccacccucggcgugaacaagugccacguccagaucauggaccuggggcacaugugcgacgccaccauguccuacgagugccccaugcuggacgagggcguggagcccgacgacguggacugcuggugcaacacgaccagcaccugggucguguacgggaccugccaccacaagaagggggaggcccgccggucccgccgggccgugacgcuccccagccacuccacccgcaagcugcagacccggagccagaccuggcuggagucccgcgaguacacgaagcaccucaucaaggucgagaacuggaucuuccggaaccccggcuucgcgcugguggccguggccaucgccuggcugcucgggagcuccaccagccagaaggucaucuaccuggugaugauccugcucaucgcccccgcguacuccauccgcugcaucggcgugagcaaccgggacuucgucgaggggauguccggcggcaccuggguggacgugguccuggagcacgggggcugcgugaccgugauggcccaggacaagccgacggucgacaucgagcuggugaccaccaccgugagcaacauggccgagguccgcuccuacugcuacgaggccagcaucagcgacauggccuccgacagccggugccccacgcagggggaggcguaccucgacaagcaguccgacacccaguacgugugcaagcgcacccuggucgaccggggcuggggcaacgggugcggccuguucgggaagggcagccucgugaccugcgccaaguucacgugcuccaagaagaugaccggcaagagcauccagcccgagaaccuggaguaccgcaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgcggacaccgagaccccgcacuggaacaacaaggaggcccugguggaguucaaggacgcccacgccaagcggcagacgguggucgugcucggcagccaggagggggccgugcacaccgcgcuggccggcgcccuggaggccgagauggacggggcgaagggccgccucuccagcgggcaccugaagugccggcugaagauggacaagcuccgccugaagggcgucuccuacagccugugcaccgccgccuucaccuucacgaaggugcccgccgagacccuccacggcaccgugaccgucgaggugcaguacgccgggcgggacggccccugcaaggugcccgcgcagauggccgucgacaugcagacccugacgccgguggggcgccugaucaccgccaaccccgugaucaccgaguccaccgagaacagcaagaugaugcucgagcuggacccgcccuucggcgacagcuacaucgucaucggcgugggggacaagaagaucacgcaccacuggcaccgguccggcagcaucaucgggaaggccuucgaggccaccgugcgcggcgcgaagcggauggccguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcgcucgggggcgugaugaucuuccucagcaccgccguguccgccgacgucgggugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7875 - RNA, 2347 nt, Artificial Sequence
  KX601166.1 prME-long mRNA Design 3 GC
gggagaaagcuuaccaugcgcaucaucaacgcccggaaggagcgcaagcggcgcggcgccgacaccagcaucgggaucgugggccugcuccugaccacggcgauggccgccgagaucacccggcgcggguccgccuacuacauguaccuggaccggagcgacgccggcaaggcgaucuccuucgccaccacccucggggucaacaagugccacgugcagaucauggaccugggccacaugugcgacgccacgaugagcuacgagugccccaugcuggacgagggcguggagcccgacgacgucgacugcuggugcaacaccaccuccaccugggugguguacgggacgugccaccacaagaagggcgaggcccgccggagccgccgggcggucacccuccccucccacagcacccgcaagcugcagacccggucccagacguggcuggagagccgcgaguacaccaagcaccucaucaagguggagaacuggaucuuccggaaccccggguucgcccugguggccgucgccaucgccuggcugcucggcuccagcaccucccagaaggugaucuaccuggugaugauccugcucaucgcgcccgccuacagcauccgcugcaucggggucuccaaccgggacuucguggagggcaugagcggcgggaccuggguggacgucgugcuggagcacggcgggugcgugacggucauggcccaggacaagccgaccguggacaucgagcuggugaccaccacggucuccaacauggccgaggugcgcagcuacugcuacgaggccuccaucagcgacauggcgagcgacucccggugccccacccagggcgaggccuaccucgacaagcagagcgacacccaguacgugugcaagcgcacccuggucgaccggggcugggggaacggcugcgggcuguucggcaaggggucccucgugacgugcgccaaguucacgugcagcaagaagaugaccggcaaguccauccagcccgagaaccuggaguaccgcaucaugcugagcguccacggcucccagcacagcgggaugaucgugaacgacgagaaccgcgccaagguggaggucacccccaacuccccgcgggccgaggcgacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgccgacaccgggacgccgcacuggaacaacaaggaggcccugguggaguucaaggacgcccacgcgaagcggcagaccgucguggugcucggcagccaggagggggccguccacaccgcccuggccggcgcgcuggaggccgagauggacggggccaagggccgccucuucuccggccaccugaagugccggcugaagauggacaagcuccgccugaagggggugagcuacucccugugcaccgccgccuucacguucaccaaggugcccgcggagacccuccacggcaccgucaccguggaggugcaguacgccgggacggacggccccugcaagguccccgcccagauggccguggacaugcagacccugaccccggugggccggcugaucaccgccaaccccgucaucacggagagcaccgagaacuccaagaugaugcucgagcuggacccgcccuucggggacagcuacaucgugaucggcgugggggacaagaagaucacccaccacuggcaccgcuccggcagcaccaucgggaaggcguucgaggccacgguccggggcgccaagcgcauggccgugcugggcgacaccgccugggacuucgggagcgugggcggggucuucaacucccucggcaaggggauccaccagaucuucggcgcggccuucaagagccuguucggcgggauguccugguucagccagauccugaucggcacccugcucguguggcuggggcugaacaccaagaacggcuccaucagccucacgugccuggcccucgggggcgugaugaucuuccuguccaccgccgucagcgcggacgugggcugcuccguggacuucagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7876 - RNA, 2365 nt, Artificial Sequence
  KF383118.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccacccucggggugaacaagugccacguccagaucauggaccugggccacaugugcgacgccacgaugagcuacgagugccccaugcuggacgagggcguggagccggacgacguggacugcuggugcaacaccaccuccaccugggucguguacgggacgugccaccacaagaagggcgagacccgccggagccgccgguccgugagccuccgcuaccacuacacccggaagcugcagacccgcucccagacguggcuggagagccgggaguacaagaagcaccucaucauggucgagaacuggaucuuccgcaaccccggguucgccaucguguccguggcgaucaccuggcugaugggcagccugaccucccagaaggucaucuaccucgugaugaucgugcugaucguccccgccuacagcaucuccugcaucggggugagcaaccgggaccugguggagggcauguccggcgggaccugggucgacguggugcucgagcacggcgggugcgucacggagauggcccaggacaagcccaccguggacaucgagcuggugaccaugaccgucagcaacauggccgaggugcgcuccuacugcuacgaggccagccugagcgacauggcguccgccagccggugcccgacgcagggcgagcccucccucgacaagcagagcgacacccaguccgugugcaagcgcacccugggcgaccggggguggggcaacgggugcggcaucuucgggaagggcagccuggugaccugcuccaaguucacgugcugcaagaagaugcccggcaagagcauccagcccgagaaccucgaguaccgcaucaugcugccgguccacgggucccagcacagcggcaugaucgucaacgacaucgggcacgagaccgacgagaaccgcgccaagguggaggugacccccaacagcccccgggccgaggccacccugggcggguucggcucccucggccuggacugcgagccccgcacggggcuggacuucuccgaccucuacuaccugaccaugaacaacaagcacuggcugguccacaaggagugguuccacgacaucccgcuccccuggcacgcgggcgccgacaccgggacgccccacuggaacaacaaggaggcccugguggaguucaaggacgcccacgccaagcggcagaccguggucgugcugggcagccaggagggggcggugcacaccgcccucgccggcgcccuggaggccgagauggacggcgcgaaggggcgccuguucuccggccaccucaagugccggcugaagauggacaagcugcgccucaagggggucagcuacucccugugcaccgccgccuucaccuucacgaaggugcccgccgagacccugcacggcaccgugaccgucgaggugcagagcgcgggcaccgacgggccgugcaaggugcccgcccagauggccgucgacaugcagacgcucacccccgugggccggcugaucaccgccaaccccgugaucaccgaguccacggagaacagcaagaugaugcuggagcucgacccgcccuucggggacagcuacaucgucaucggcgugggggacaagaagaucacccaccacuggcaccgcuccggcagcaccaucggcaaggccuucgaggcgaccgugcgcggggccaagcggauggccguccugggcgacacggccugggacuucggguccgugggcgggguguucaacagccugggcaagggcauccaccagaucuucggggccgcguucaagucccucuucggcgggaugagcugguucucccagauccugaucggcacccugcuggucuggcucgggcugaacaccaagaacggcagcaucucccugaccugccucgcccugggcggggugaugaucuuccugagcacggccguguccgccgacgucggcugcagcguggacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7877 - RNA, 2359 nt, Artificial Sequence
  KF383120.1 prME-long mRNA Design 3 GC
gggagaaagcuuaccaugcgcaucaucaacgcccggaaggagcgcaagcggcgcggcgccgacaccagcaucgggaucaucggccugcuccugaccacggcgauggccgccgagaucacccggcgcggguccgccuacuacauguaccuggaccggagcgacgccggcaaggcgaucuccuucgccaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccgccccagccggcgcgcggugacccugcccucccacagcacccggaagcuccagacccgcucccagacguggcuggagagccgggaguacaccaagcaccugaucaaggucgagaacuggauccuccgcaaccccggguucaccguggccgcccuggccauggccuggcugcucggcaacuccaccagccagcgggugaucuaccuggucaugauccugcucaucgcgccggccuacuccauccgcugcaucggggugagcaaccgggacuucguggagggcauguccggcgggacgugggucgacguggugcuggagcacggcgggugcgucaccgugauggcccaggacaagcccaccguggacaucgagcuggucaccacgaccgugagcaacauggccgaggugcgcuccuacugcuacgaggccagcaucuccgacauggcgagcgacagccggugccccacccagggcgaggccuaccucgacaagcaguccgacacccaguacgucugcaagcgcacgcugguggaccggggcugggggaacggcugcgggcuguucggcaaggggagccucgugaccugcgccaaguucacgugcuccaagaagaugaccggcaagagcauccagcccgagaaccuggaguaccgcaucaugcuguccguccacggcagccagcacuccgggaugaucgugaacgacaucggccacgagaccgacgagaaccgcgccaaggucgaggugaccccgaacagcccccgggccgaggcgacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgccggggccgacaccggcacgccccacuggaacaacaaggaggcccuggucgaguucaaggacgcccacgcgaagcggcagaccguggugguccucgggucccaggagggcgccgugcacaccgcccuggccggggcgcuggaggccgagauggacggcgccaagggccgccucuucagcgggcaccugaagugccggaucaagauggacaagcugcgccucaagggcguguccuacagccugugcaccgccgccuucaccuucuccaagguccccgcggagacccugcacgggaccgugacgguggagguccaguacgccggccgggacggccccugcaaggugccggcccagauggccguggacaugcagacccucacccccgucgggcgccugaucaccgccaaccccaucaucacggagagcaccgagaacucccggaugaugcuggagcucgacccgcccuucggcgacagcuacaucgugaucggggugggcgacaagaagaucacccaccacuggcaccgcuccgggagcaccaucggcaaggcguucgaggccacgguccggggcgccaagcgcauggccgugcugggggacaccgccugggacuucggcagcgucgggggcguguucaacucccuggggaagggcgugcaccagguguucggcgcggccuucaagagccucuucgggggcauguccugguucagccagauccugaucgggacccugcuggucuggcucggccugaacaccaagaacggguccaucagccuggccugccucgcccugggcggcgcgaugaucuuccuguccacggccgugagcgccgacguggggugcuccgucgacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7878 - RNA, 2290 nt, Artificial Sequence; identical to SEQ ID NO: 7713
  KU321639.1 prME-short mRNA Design 3 GC

SEQ ID NO: 7879 - RNA, 2290 nt, Artificial Sequence; identical to SEQ ID NO: 7714
  KU312312.1 prME-short mRNA Design 3 GC

SEQ ID NO: 7880 - RNA, 2278 nt, Artificial Sequence; identical to SEQ ID NO: 7715
  AY632535.2 prME-short mRNA Design 3 GC

SEQ ID NO: 7881 - RNA, 2290 nt, Artificial Sequence; identical to SEQ ID NO: 7716
  KU527068.1 prME-short mRNA Design 3 GC

SEQ ID NO: 7882 - RNA, 2290 nt, Artificial Sequence
  KX421193.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaccggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7883 - RNA, 2290 nt, Artificial Sequence
  KX377335.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccggaagaagggggaggcccgccggagccgccgggccgugacccuccccucccacagcacccgcaagcugcagacccggucccagacguggcuggagagccgcgaguacaccaagcaccucaucaaggucgagaacuggaucuuccggaaccccggcuucgcccugguggcgguggccaucgccuggcugcucggguccagcaccucccagaaggucaucuaccuggugaugauccugcucaucgcccccgccuacagcauccgcugcaucggcguguccaaccgggacuucgucgaggggaugagcggcggcaccuggguggacgugguccuggagcacgggggcugcgugacggugauggcgcaggacaagccgaccgucgacaucgagcuggugaccaccacgguguccaacauggccgagguccgcagcuacugcuacgaggccuccaucagcgacauggccagcgacucccggugccccacccagggggaggccuaccucgacaagcagagcgacacccaguacgugugcaagcgcacccugguggaccggggcuggggcaacgggugcggccuguucgggaagggcucccucgucacgugcgcgaaguucacgugcagcaagaagaugaccgggaaguccauccagcccgagaaccuggaguaccgcaucaugcugagcgugcacggcucccagcacagcggcaugaucgucaacgacaccggguacgagaccgacgagaaccgggccaagguggaggugacccccaacuccccgcgcgccgaggccacccucggcggguucggcagccuggggcuggacugcgagccccggaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcgccagaccguggucgugcucggcagccaggagggggccgugcacacggcgcuggccggcgcccuggaggccgagauggacggggcgaagggcaagcuguucuccggccaccugaagugccgccugaagauggacaagcuccggcugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccgccugaucaccgccaaccccgugaucaccgagagcaccgagaacuccaagaugaugcucgagcuggacccgcccuucggggacagcuacaucgucaucggcgugggggacaagaagaucacgcaccacuggcaccgguccggcagcaccaucgggaaggccuucgaggccaccgugcgcggcgccaagcggauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7884 - RNA, 2290 nt, Artificial Sequence
  LC002520.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaccgucaacgacaucggguacgagaccgacgagaaccgcgccaagguggaggugacccccaacuccccgcgggccgaggccacccucggcggguucggcagccuggggcuggacugcgagccccgcaccggccucgacuucuccgaccuguacuaccugacgaugaacaacaagcacuggcucguccacaaggagugguuccacgacaucccccugcccuggcacgccggcgcggacaccgggaccccgcacuggaacaacaaggaggcccugguggaguucaaggacgcccacgccaagcggcagaccguggucgugcucggcagccaggagggggccgugcacacggcgcuggccggcgcccuggaggccgagauggacggggcgaagggcaagcuguucuccggccaccugaagugccgccugaagauggacaagcuccgccugaagggggucagcuacucccugugcaccgccgccuucaccuucaccaaggugcccgccgagacccuccacggcacggugaccgucgaggugcaguacgccgggaccgacggccccugcaagauccccgugcagauggcggucgacaugcagacccugacgccggugggccggcugaucaccgccaaccccgugaucaccgagagcaccgagaacuccaagaugaugcucgagcuggacccgcccuucggggacagcuacaucgucaucggcgugggggacaagaagaucacgcaccacuggcaccgcuccggcagcaccaucgggaaggccuucgaggccaccgugcggggcgccaagcgcauggcgguccugggcgacaccgccugggacuucgggagcgugggcgggguguucaacucccucggcaaggggauccaccagaucuucggcgccgccuucaagagccuguucggcgggauguccugguucagccagauccugaucggcacgcugcucgucuggcuggggcugaacaccaagaacggcuccaucagccugaccugccucgcccucgggggcgugaugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7885 - RNA, 2272 nt, Artificial Sequence
  DQ859059.1 prME-short mRNA Design 3 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgcgaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgccgacacgggcaccccgcacuggaacaacaaggaggcgcugguggaguucaaggacgcccacgccaagcggcagaccgucguggugcucgggagccaggagggcgccguccacaccgcccuggcgggggcccuggaggccgagauggacggcgccaaggggcgccucuucuccggccaccugaagugccgccugaagauggacaagcuccggcugaagggcgugagcuacucccugugcacggcggccuucaccuucaccaaggugcccgccgagacccuccacgggaccgucacgguggaggugcaguacgccggcaccgacgggcccugcaagguccccgcccagauggcgguggacaugcagacccugaccccggugggccgccugaucacggccaaccccgucaucaccgagagcaccgagaacuccaagaugaugcucgagcuggacccgcccuucggcgacagcuacaucgugaucggggugggcgacaagaagaucacccaccacuggcaccgguccgggagcacgaucggcaaggccuucgaggccaccguccgcggggccaagcggauggcggugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacacgaagaacggguccaucagccugaccugccucgcccugggcggggugaugaucuuccucuccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7886 - RNA, 2278 nt, Artificial Sequence
  KU963573.2 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucggguacgagaccgacgagaaccgcgccaaggucgaggugacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccuggucgaguucaaggacgcccacgccaagcggcagaccguggugguccucggcagccaggagggggccgugcacaccgcgcuggccggcgcccuggaggccgagauggacggggcgaagggcaagcuguucuccggccaccugaagugccgccugaagauggacaagcuccgccugaagggggugagcuacucccugugcacggccgccuucaccuucaccaagguccccgccgagacccuccacggcaccgugacgguggagguccaguacgccgggaccgacggccccugcaagauccccgugcagauggcgguggacaugcagacccugaccccggucggccggcugaucacggccaaccccgugaucaccgagagcaccgagaacuccaagaugaugcucgagcuggacccgcccuucggggacagcuacaucgugaucggcgucggggacaagaagaucacccaccacuggcaccgcuccggcagcacgaucgggaaggccuucgaggccaccgugcggggcgccaagcgcauggcggugcugggcgacaccgccugggacuucgggagcgucggcgggguguucaacucccucggcaaggggauccaccagaucuucggcgccgccuucaagagccuguucggcgggauguccugguucagccagauccugaucggcacccugcucguguggcuggggcugaacacgaagaacggcuccaucagccugaccugccucgcccucgggggcgucaugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7887 - RNA, 2290 nt, Artificial Sequence
  KX694534.2 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggccgggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7888 - RNA, 2290 nt, Artificial Sequence
  KX369547.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggccuggcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7889 - RNA, 2290 nt, Artificial Sequence
  KX447515.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacugguaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7890 - RNA, 2290 nt, Artificial Sequence
  KU729218.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacacccagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7891 - RNA, 2290 nt, Artificial Sequence
  KU501217.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgagauccgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7892 - RNA, 2290 nt, Artificial Sequence
  KU312314.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugcuggcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7893 - RNA, 2290 nt, Artificial Sequence
  KX446950.2 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgacccuggacgagggcguggagcccgacgacgucgacugcuggugcaacaccaccagcacgugggugguguacgggaccugccaccacaagaagggggaggcgcggcgcucccggcgcgccgucacccuccccagccacuccacccggaagcugcagacgcgcagccagaccuggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcacgugggucgacguggugcuggagcacgggggcugcgucaccgugauggcccaggacaagcccaccguggacaucgagcuggucaccacgaccgugagcaacauggccgaggugcgcuccuacugcuacgaggccagcaucuccgacauggccagcgacagccggugccccacccagggggaggcguaccucgacaagcaguccgacacccaguacgucugcaagcgcacgcugguggaccggggcuggggcaacgggugcggccuguucgggaagggcagccucgugaccugcgccaaguucgccugcuccaagaagaugaccggcaagagcauccagcccgagaaccuggaguaccgcaucaugcuguccguccacggcagccagcacuccggcaugaucgugaacgacaccgggcacgagacggacgagaaccgggccaaggucgagaucaccccgaacagcccccgcgccgaggcgacccucggcggguucggcucccuggggcuggacugcgagccccggaccggccucgacuucagcgaccuguacuaccugacgaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgagagcaccgagaacuccaagaugaugcucgagcuggacccgcccuucggggacagcuacaucgucaucggcgugggggagaagaagaucacgcaccacuggcaccgcuccggcagcaccaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacgcuccugauguggcuggggcucaacaccaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7894 - RNA, 2290 nt, Artificial Sequence
  KY003157.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgucgugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7895 - RNA, 2290 nt, Artificial Sequence
  KX811222.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcgcgugggugguguacgggaccugccaccacaagaagggcgaggcccggcgcucccggcgcgccgucacgcuccccagccacuccacccggaagcugcagacccgcccccagaccuggcuggagagccgggaguacacgaagcaccucauccgcguggagaacuggaucuuccggaacccgggcuucgcccuggcggccgccgccaucgccuggcugcucggguccagcaccucccagaaggugaucuaccuggucaugauccugcucaucgcgcccgccuacagcauccgcugcaucggcguguccaaccgggacuucguggaggggaugagcggcggcaccugggucgacguggugcuggagcacgggggcugcgucaccgugauggcccaggacaagcccacgguggacaucgagcuggucaccaccaccguguccaacauggccgaggugcgcagcuacugcuacgaggccuccaucagcgacauggcguccgacagccggugccccacgcagggggaggccuaccucgacaagcagagcgacacccaguacgucugcaagcgcacccugguggaccggggcuggggcaacgggugcggccuguucgggaagggcucccucgugaccugcgccaaguucgccugcagcaagaagaugacggggaaguccauccagccggagaaccuggaguaccgcaucaugcugagcguccacggcucccagcacagcggcaugaucgugaacgacaccgggcacgagaccgacgagaaccgggccaaggucgagaucacccccaacagcccccgcgcggaggccacgcucggcggguucggcucccuggggcuggacugcgagccccggaccggccucgacuucuccgaccuguacuaccugaccaugaacaacaagcacuggcucgugcacaaggagugguuccacgacaucccgcugcccuggcacgccggcgccgacaccgggacgccccacuggaacaacaaggaggcccugguggaguucaaggacgcgcacgccaagcgccagaccgucguggugcucggcagccaggagggggccguccacaccgcccuggcgggcgcccuggaggccgagauggacggggccaagggccgccucuccagcggccaccugaagugccggcugaagauggacaagcuccgccugaaggggguguccuacagccugugcaccgccgcguucacguucaccaagauccccgccgagacccuccacggcaccgugaccgucgaggugcaguacgccgggacggacggcccgugcaaggugcccgcccagauggccgucgacaugcagacccugacccccgugggccggcugaucaccgcgaaccccgugaucacggaguccaccgagaacagcaagaugaugcucgagcuggacccgcccuucggggacuccuacaucgucaucggcgugggggagaagaagaucacccaccacuggcaccgcagcggcuccaccaucgggaaggccuucgaggccacggugcggggcgccaagcgcauggccguccugggcgacaccgcgugggacuucgggagcgugggcggggcccucaacagccugggcaaggggauccaccagaucuucggcgccgccuucaagucccuguucggcgggaugagcugguucucccagauccugaucggcacccuccugauguggcuggggcucaacaccaagaacggcagcaucucccugaugugccuggcgcucgggggcgugcugaucuuccugagcacggccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7896 - RNA, 2290 nt, Artificial Sequence
  KX447516.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagcaagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7897 - RNA, 2290 nt, Artificial Sequence
  KX520666.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccacccgccagaaggugaucuaccuggucaugauccugcucaucgccccggcguacagcauccggugcaucggcguguccaaccgcgacuucguggaggggaugagcggcggcaccugggucgacguggugcuggagcacgggggcugcgucacggugauggcccaggacaagcccaccguggacaucgagcuggucaccaccacgguguccaacauggccgaggugcggagcuacugcuacgaggccuccaucagcgacauggccuccgacagccgcugccccacccagggggaggcguaccucgacaagcagagcgacacccaguacgucugcaagcggacccugguggaccgcggcuggggcaacgggugcggccuguucgggaagggcucccucgugacgugcgccaaguucgccugcagcaagaagaugaccgggaaguccauccagcccgagaaccuggaguaccggaucaugcugagcguccacggcucccagcacagcggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccggcucuccagcggccaccugaagugccgccugaagauggacaagcuccggcugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgaguccaccgagaacagcaagaugaugcucgagcuggacccgcccuucggggacuccuacaucgucaucggcgugggggagaagaagaucacccaccacuggcaccggagcggcuccacgaucgggaaggcguucgaggccaccgugcgcggcgccaagcggauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7898 - RNA, 2290 nt, Artificial Sequence
  KU497555.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcacccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcacggugaccgucgaggugcaguacgccgggaccgacggccccugcaaggugccggcccagauggccgucgacaugcagacccugacgcccgugggccggcugaucaccgccaaccccgugaucaccgaguccaccgagaacagcaagaugaugcucgagcuggacccgcccuucggggacuccuacaucgucaucggcgugggggagaagaagaucacgcaccacuggcaccgcagcggcuccaccaucgggaaggcguucgaggccaccgugcggggcgccaagcgcauggccguccugggcgacaccgccugggacuucgggagcgugggcggggcgcucaacagccugggcaaggggauccaccagaucuucggcgccgccuucaagucccuguucggcgggaugagcugguucucccagauccugaucggcacgcuccugauguggcuggggcucaacaccaagaacggcagcaucucccugaugugccuggcccucgggggcgugcugaucuuccugagcaccgcggucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7899 - RNA, 2290 nt, Artificial Sequence
  KY075939.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacucccugcgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7900 - RNA, 2290 nt, Artificial Sequence
  KY075932.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcaucgagaacuggaucuuccggaaccccggcuucgcccuggccgcggccgccaucgccuggcugcucgggagcuccaccagccagaaggugaucuaccuggugaugauccugcucaucgccccggcguacuccauccgcugcaucggcgucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcucccuggggcuggacugcgagccccggaccggccucgacuucagcgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcucccaggagggggccgugcacaccgcccuggccggcgcgcuggaggccgagauggacggggccaagggccgccucagcuccggccaccugaagugccggcugaagauggacaagcuccgccugaagggggucagcuacucccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7901 - RNA, 2290 nt, Artificial Sequence
  KU870645.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauccugcggaaccccggcuucgcccuggccgcggccgccaucgccuggcuccuggggagcuccaccagccagaaggugaucuaccuggucaugauccuccugaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgccgaacagcccccgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugccguggcacgccggcgccgacacggggacgccccacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcaccgccgccuucaccuucaccaagauccccgcggagacccugcacggcaccgugacggucgaggugcaguacgccgggaccgacggccccugcaaggugccggcccagauggccgucgacaugcagacccugacccccgugggccggcucaucacggccaaccccgugaucaccgagagcaccgagaacuccaagaugaugcuggagcuggacccgcccuucggggacagcuacaucgucaucggcaucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7902 - RNA, 2290 nt, Artificial Sequence
  KU729217.2 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucagcaccaccguguccaacauggccgaggugcgcagcuacugcuacgaggccacgaucuccgacaucgccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgccgucgugcucggcucccaggagggggccgugcacaccgcccuggcgggcgcccuggaggccgagauggacggggccaagggccgccucagcuccggccaccugaagugccggcugaagauggacaagcuccgccugaagggggucagcuacucccugugcaccgccgcguucaccuucaccaagauccccgccgagacccuccacggcaccgugacgguggagguccaguacgccgggaccgacggccccugcaaggugccggcccagauggccguggacaugcagacccugacccccgucggccggcugaucacggcgaaccccgugaucaccgagagcaccgagaacuccaagaugaugcucgagcuggacccgcccuucggggacagcuacaucgugaucggcgucggggagaagaagaucacccaccacuggcaccgcuccggcagcacgaucgggaaggccuucgaggccaccgugcggggcgccaagcgcauggccgugcugggcgacaccgcgugggacuucgggagcgucggcggggcccucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcgcucgggggcgugcugaucuuccuguccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7903 - RNA, 2290 nt, Artificial Sequence
  KX087101.3 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgagcugcaguacgccgggaccgacggccccugcaaggugccggcccagauggccguggacaugcagacccugacccccgucggccggcucaucacggccaaccccgugaucaccgagagcaccgagaacuccaagaugaugcuggagcuggacccgcccuucggggacagcuacaucgugaucggcgucggggagaagaagaucacccaccacuggcaccgcuccggcagcacgaucgggaaggcguucgaggccaccgugcggggcgccaagcgcauggccgugcucggcgacaccgccugggacuucgggagcgucggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7904 - RNA, 2290 nt, Artificial Sequence
  KY014317.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaucgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7905 - RNA, 2290 nt, Artificial Sequence
  KU758876.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggugaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagcuucaugugccuggcccucgggggcguccugaucuuccuguccaccgccgugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7906 - RNA, 2290 nt, Artificial Sequence
  KU758874.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggcaagcucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7907 - RNA, 2290 nt, Artificial Sequence
  KY317939.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaaggacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7908 - RNA, 2290 nt, Artificial Sequence
  KY014314.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggaggcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7909 - RNA, 2290 nt, Artificial Sequence
  KX447517.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcggcccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagacccugaucggcacccuccugauguggcuggggcucaacacgaagaacggcuccaucagccugaugugccuggcgcucgggggcgugcugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7910 - RNA, 2290 nt, Artificial Sequence
  KU926310.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccggggccgacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7911 - RNA, 2290 nt, Artificial Sequence
  KU922923.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugccccaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgcccuggcguacuccauccgcugcaucggcgugagcaaccgggacuucguggaggggauguccggcggcaccugggucgacguggugcuggagcacgggggcugcgucacggugauggcccaggacaagccgaccguggacaucgagcucgucaccaccacggugagcaacauggccgaggugcgcuccuacugcuacgaggccagcaucuccgacauggccagcgacagccggugccccacccagggggaggcguaccuggacaagcaguccgacacccaguacgucugcaagcgcacccugguggaccggggcuggggcaacgggugcggccucuucgggaagggcagccuggugacgugcgccaaguucgccugcuccaagaagaugaccggcaagagcauccagcccgagaaccuggaguaccgcaucaugcucuccguccacgggagccagcacuccggcaugaucgugaacgacaccgggcacgagaccgacgagaaccgggccaaggucgagaucacgcccaacagcccgcgcgccgaggcgacccugggcggguucggcucccuggggcucgacugcgagccccggaccggccuggacuucagcgaccuguacuaccucaccaugaacaacaagcacuggcuggugcacaaggagugguuccacgacaucccccugcccuggcacgccggcgccgacacggggaccccgcacuggaacaacaaggaggcccucguggaguucaaggacgcccacgcgaagcgccagaccgucguggugcugggcucccaggagggggccguccacaccgcccuggccggcgcgcucgaggccgagauggacggggccaagggccgccugagcuccggccaccugaagugccggcucaagauggacaagcugcgccugaagggggugagcuacucccucugcacggccgccuucaccuucaccaagauccccgcggagacccugcacggcaccgugacggucgaggugcaguacgccgggaccgacggccccugcaaggugcccgcccagauggccgucgacaugcagacccugaccccggugggccggcucaucacggccaaccccgugaucaccgagagcaccgagaacuccaagaugaugcuggagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccucggcgacaccgccugggacuucgggagcgugggcggggcgcugaacucccugggcaaggggauccaccagaucuucggcgccgccuucaagagccuguucggcgggauguccugguucagccagauccucaucggcacccugcugauguggcucgggcugaacacgaagaacggcuccaucagccugaugugccucgcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7912 - RNA, 2290 nt, Artificial Sequence
  KY075937.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggucagcgacagccggugccccacccagggggaggccuaccucgacaagcaguccgacacccaguacgugugcaagcgcacccugguggaccggggcuggggcaacgggugcggccuguucgggaagggcagccucgucacgugcgcgaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggccacccucggcggguucggcucccuggggcuggacugcgagccccggaccggccucgacuucagcgaccuguacuaccugaccaugaacaacaagcacuggcucgugcacaaggagugguuccacgacaucccccugccguggcacgcgggcgccgacacggggacgccccacuggaacaacaaggaggcccuggucgaguucaaggacgcccacgccaagcgccagaccguggugguccucggcucccaggagggggcggugcacaccgcccuggccggcgcccuggaggcggagauggacggggccaagggccgccucagcuccggccaccugaagugccggcugaagauggacaagcuccgccugaagggggugagcuacucccugugcaccgccgccuucaccuucaccaagauccccgccgagacccuccacggcaccgucacgguggaggugcaguacgcggggaccgacggccccugcaaggucccggcccagauggccguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccucaacucccugggcaaggggauccaccagaucuucggcgcggccuucaagagccuguucggcgggauguccugguucagccagauccugaucggcacccuccugauguggcuggggcucaacacgaagaacggcuccaucagccugaugugccuggcccucgggggcguccugaucuuccuguccaccgccgugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7913 - RNA, 2290 nt, Artificial Sequence
  KY003156.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcaucagcaaccgggacuucguggaggggauguccggcggcaccuggguggacgucgugcuggagcacgggggcugcgugacggucauggcccaggacaagcccaccguggacaucgagcuggugaccaccacggucagcaacauggccgaggugcgcuccuacugcuacgaggccagcaucuccgacauggccagcgacagccggugccccacccagggggaggcguaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugaucgucaacgacaccgggcacgagaccgacgagaaccgggccaagguggagaucacgccgaacagcccccgcgccgaggcgacccucggcggguucggcauccuggggcuggacugcgagccccggaccggccucgacuucuccgaccuguacuaccugaccaugaacaacaagcacuggcucguccacaaggagugguuccacgacaucccccugccguggcacgccggcgccgacacggggacgccccacuggaacaacaaggaggcccugguggaguucaaggacgcccacgcgaagcgccagaccguggucgugcucggcagccaggagggggccgugcacaccgcccuggccggcgcgcuggaggccgagauggacggggccaagggccgccucuccagcggccaccugaagugccggcugaagauggacaagcuccgccugaagggggucuccuacagccugugcaccgccgccuucaccuucaccaagauccccgcggagacccuccacggcaccgugacgguggagguccaguacgccgggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcuccacgaucgggaaggcguucgaggccaccgugcggggcgccaagcgcauggccgugcugggcgacaccgccugggacuucgggagcgucggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7914 - RNA, 2290 nt, Artificial Sequence
  KU312313.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacacgugcgacgccaccauguccuacgagugcccgaugcuggacgagggcguggagcccgacgacgucgacugcuggugcaacaccaccagcacgugggugguguacgggaccugccaccacaagaagggggaggcgcggcgcucccggcgcgccgucacccuccccagccacuccauccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacggcagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacgccaagaacggcuccaucagccugaugugccuggcgcucgggggcgugcugaucuuccuguccacggccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7915 - RNA, 2290 nt, Artificial Sequence
  KY075935.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcagcggucccgccgggccgucacccuccccagccacuccacccgcaagcugcagacccggagccagacguggcuggagucccgcgaguacaccaagcaccucauccggguggagaacuggaucuuccgcaaccccggcuucgcccuggccgcggccgccaucgccuggcugcucgggagcuccaccagccagaaggugaucuaccuggucaugauccugcucaucgccccggcguacuccauccggugcaucggcgugagcaaccgcgacuucguggaggggauguccggcggcaccugggucgacguggugcuggagcacgggggcugcgucacggugauggcccaggacaagcccaccguggacaucgagcuggucaccaccacggugagcaacauggccgaggugcgguccuacugcuacgaggccagcaucuccgacauggccagcgacagccgcugccccacccagggggaggcguaccucgacaagcaguccgacacccaguacgucugcaagcggacccugguggaccgcggcuggggcaacgggugcggccuguucgggaagggcagccucgugacgugcgccaaguucgccugcuccaagaagaugaccggcaagagcauccagcccgagaaccuggaguaccggaucaugcuguccguccacgggagccagcacuccggcaugaucgugaacgacaccgggcacgagaccgacgagaaccgcgccaaggucgagaucacgccgaacagcccccgggccgaggcgacccucggcggguucggcucccuggggcuggacugcgagccccgcaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcggcagaccgucguggugcucggcucccaggagggggccguccacaccgcccuggccggcgcgcuggaggccgagauggacggggccaagggccgccucagcuccggccaccugaagugccgccugaagauggacaagcuccggcugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccgccugaucacggccaaccccgugaucaccgagagcaccgagaacuccaagaugaugcucgagcuggacccgcccuucggggacagcuacaucgucaucggcgugggggagaagaagaucacccaccacuggcaccgguccggcagcacgaucgggaaggcguucgaggccaccgugcgcggcgccaagcggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7916 - RNA, 2290 nt, Artificial Sequence
  KY014320.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcaggcccgcagccagaccuggcuggagucccgggaguacacgaagcaccucauccgcguggagaacuggaucuuccggaaccccggcuucgcccuggcggccgccgccaucgccuggcugcucgggagcuccaccagccagaaggugaucuaccuggucaugauccugcucaucgcgccggccuacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggcgagcgacagccggugccccacgcagggggaggccuaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacgggagccagcacuccggcaugaucgugaacgacaccgggcacgagaccgacgagaaccgggccaaggucgagaucaccccgaacagcccccgcgcggaggccacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcgcacgccaagcgccagaccgucguggugcucggcucccaggagggggccguccacaccgcccuggcgggcgcccuggaggccgagauggacggggccaagggccgccucagcuccggccaccugaagugccggcugaagauggacaagcuccgccugaagggggugagcuacucccugugcaccgccgcguucacguucaccaagauccccgccgagacccuccacggcaccgugaccgucgaggugcaguacgccgggacggacggccccugcaaggugccggcccagauggccgucgacaugcagacccugacccccgugggccggcugaucaccgcgaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggccuucgaggccacggugcggggcgccaagcgcauggccguccugggcgacaccgcgugggacuucgggagcgugggcggggcccucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcgcucgggggcgugcugaucuuccuguccacggccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7917 - RNA, 2290 nt, Artificial Sequence
  KY328290.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucuccaagauccccgcggagacccuccacggcaccgugaccgaggagguccaguacgccgggacggacggccccugcaaggugccggcccagauggccguggacaugcagacccugacccccgucggccggcugaucaccgccaaccccgugaucacggagagcaccgagaacuccaagaugaugcucgagcuggacccgcccuucggggacagcuacaucgugaucggcgucggggagaagaagaucacccaccacuggcaccgcagcggcuccaccaucgggaaggcguucgaggccacggugcggggcgccaagcgcauggccgugcugggcgacaccgccugggacuucgggagcgucggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7918 - RNA, 2290 nt, Artificial Sequence
  KU681081.3 prME-short mRNA Design 3 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacacgggcgccgacaccgggacgccccacuggaacaacaaggaggcccugguggaguucaaggacgcccacgccaagcgccagaccgucguggugcucggcagccaggagggggcgguccacaccgcccuggccggcgcccuggaggcggagauggacggggccaagggccgccucuccagcggccaccugaagugccggcugaagauggacaagcuccgccugaaggggguguccuacagccugugcaccgccgccuucaccuucaccaagauccccgccgagacccuccacggcacggugaccgucgaggugcaguacgcggggaccgacggccccugcaaggugccggcccagauggccgucgacaugcagacccugacgcccgugggccggcugaucaccgccaaccccgugaucaccgaggggaccgagaacuccaagaugaugcucgagcuggacccgcccuucggcgacagcuacaucgucaucggggugggcgagaagaagaucacgcaccacuggcaccgcuccgggagcaccaucggcaaggccuucgaggcgaccgugcggggcgccaagcgcauggccguccugggggacaccgccugggacuucggcagcgucgggggcgugcucaacucccuggggaagggcauccaccagaucuucggcgccgcguucaagagccuguucgggggcauguccugguucagccagauccugaucgggacgcuccugauguggcugggccucaacaccaagaacggguccaucagccugaugugccuggcccucggcggcgugcugaucuuccuguccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7919 - RNA, 2290 nt, Artificial Sequence
  KX827309.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccugaugugccuggcccucgggggcgugcugaucuuccugagcaccgcggucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7920 - RNA, 2290 nt, Artificial Sequence
  KU955593.1 prME-short mRNA Design 3 GC
gggagaaagcuuaccaugaccagcgugggcaucgucgggcugcuccugaccacggccauggccguggaggugacccgccggggcaacgcguacuacauguaccuggaccgcuccgacgccggggaggccaucagcuuccccaccaccaugggcaugaacaagugcuacauccagaucauggaccucgggcacaugugcgacgccacgauguccuacgagugcccgaugcuggacgagggcgucgagcccgacgacguggacugcuggugcaacaccaccagcaccuggguggucuacggcacgugccaccacaagaagggggaggcccggcgcucccggcgcgcggugacccugcccagccacuccacccggaagcuccagacccgcagccagacguggcuggagucccgggaguacaccaagcaccugauccgcguggagaacuggaucuuccggaaccccggcuucgcccucgccgccgcggccaucgccuggcugcuggggagcuccaccagccagaaggucaucuaccucgugaugauccugcugaucgccccggccuacuccauccgcugcaucggcgugagcaaccgggacuucgucgaggggauguccggcggcaccuggguggacgugguccucgagcacgggggcugcgugacggugauggcgcaggacaagcccaccgucgacaucgagcuggugaccaccacggugagcaacauggccgagguccgcuccuacugcuacgaggccagcaucuccgacauggccagcgacagccggugccccacccagggggaggccuaccuggacaagcaguccgacacccaguacgugugcaagcgcacccucguggaccggggcuggggcaacgggugcggccuguucgggaagggcagccuggucacgugcgcgaaguucgccugcuccaagaagaugaccggcaagagcauccagcccgagaaccucgaguaccgcaucaugcuguccgugcacgggagccagcacuccggcaugaucgucaacgacaccgggcacgagaccgacgagaaccgggccaagguggagaucacgccgaacagcccccgcgccgaggccacccugggcggguucggcucccucgggcuggacugcgagccccggaccggccuggacuucagcgaccucuacuaccugaccaugaacaacaagcacuggcuggugcacaaggagugguuccacgacaucccccucccguggcacgcgggcgccgacacggggacgccccacuggaacaacaaggaggcccuggucgaguucaaggacgcccacgccaagcgccagaccguggugguccugggcucccaggagggggcggugcacaccgcccucgccggcgcccuggaggcggagauggacggggccaagggccgccugagcuccggccaccucaagugccggcugaagauggacaagcugcgccucaagggggugagcuacucccugugcaccgccgccuucaccuucaccaagauccccgccgagacccugcacggcaccgucacgguggaggugcaguacgcggggaccgacggccccugcaaggucccggcccagauggccguggacaugcagacccucacccccgugggccggcugaucacggccaaccccgucaucaccgagagcaccgagaacuccaagaugaugcuggagcucgacccgcccuucggggacagcuacaucgugaucggcgugggggagaagaagaucacccaccacuggcaccgcuccggcagcacgaucgggaaggccuucgaggcgaccguccggggcgccaagcgcauggccgugcugggcgacaccgccugggacuucgggagcgugggcggggcccugaacucccucggcaaggggauccaccagaucuucggcgcggccuucaagagccuguucggcgggauguccugguucagccagauccugaucggcacccugcucgucuggcuggggcugaacacgaagaacggcuccaucagccucaugugccuggcccucgggggcgugcugaucuuccuguccaccgccgugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7921 - RNA, 2290 nt, Artificial Sequence
  KY272987.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcguguccaaccgggacuucguggaggggaugagcggcggcaccugggucgacguggugcuggagcacgggggcugcgucacggugauggcccaggacaagcccaccguggacaucgagcuggucaccaccacgguguccaacauggccgaggugcgcagcuacugcuacgaggccuccaucagcgacauggccagcgacucccggugccccacccagggggaggcguaccucgacaagcagagcgacacccaguacgucugcaagcgcacccugguggaccggggcuggggcaacgggugcggccuguucgggaagggcucccucgugacgugcgccaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcagccaggagggggccguccacaccgcccuggccggcgcgcuggaggccgagauggacggggccaagggccgccucuccagcggccaccugaagugccggcugaagauggacaagcuccgccugaaggggguguccuacagccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgaguccaccgagaacagcaagaugaugcucgagcuggacccgcccuucggggacuccuacaucgucaucggcgugggggagaagaagaucacccaccacuggcaccgcagcggcagcacgaucgggaaggcguucgaggccaccgugcggggcgccaagcgcauggccguccugggcgacaccgccugggacuucggguccgugggcggggcgcucaacagccugggcaaggggauccaccagaucuucggcgccgccuucaagucccuguucggcgggaugagcugguucucccagauccugaucggcacccuccugauguggcuggggcucaacacgaagaacggcagcaucucccuggugugccuggcccucgggggcguccugaucuuccugagcaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7922 - RNA, 2290 nt, Artificial Sequence
  KY007221.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcguggagcccgacgacgucgacugcuggugcaacaccaccuccaccugggugguguacggcacgugccaccacaagaagggggaggcgcggcgcagccggcgcgccgucacccuccccucccacagcacccggaagcugcagacccgcucccagacguggcuggagagccgggaguacaccaagcaccucauccgcguggagaacuggaucuuccggaaccccggcuucgcccuggccgcggccgccaucgccuggcugcucggguccagcaccucccagaaggugaucuaccuggucaugauccugcucaucgccccggcguacagcauccgcugcaucggcgugaacaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccuggugugccuggcccucgggggcguccugaucuuccuguccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7923 - RNA, 2290 nt, Artificial Sequence
  EU545988.1 prME-short mRNA Design 3 GC
gggagaaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggccaucgccuggcugcucggguccagcaccucccagaaggucaucuaccuggugaugauccugcucaucgccccggccuacagcauccgcugcaucggcguguccaaccgggacuucgucgaggggaugagcggcggcaccuggguggacgugguccuggagcacgggggcugcgugacggugauggcgcaggacaagcccgccgucgacaucgagcuggugaccaccaccguguccaacauggccgagguccgcagcuacugcuacgaggccuccaucagcgacauggccagcgacucccggugccccacgcagggggaggcguaccucgacaagcagagcgacacccaguacgugugcaagcgcacccugguggaccggggcuggggcaacgggugcggccuguucgggaagggcucccucgugaccugcgccaaguucgccugcagcaagaagaugacggggaaguccauccagcccgagaaccuggaguaccgcaucaugcugagcguccacggcucccagcacagcggcaugaucgucaacgacaccgggcacgagaccgacgagaaccgggccaagguggagaucaccccgaacagcccccgcgccgaggcgacgcucggcggguucggcucccuggggcuggacugcgagccccggaccggccucgacuucuccgaccuguacuaccugaccaugaacaacaagcacuggcucgugcacaaggagugguuccacgacaucccccugccguggcacgccggcgccgacaccgggacgccccacuggaacaacaaggaggcccuggucgaguucaaggacgcccacgcgaagcgccagaccguggugguccucggcagccaggagggggccgugcacaccgcccuggccggcgcgcuggaggccgagauggacggggccaagggccgccucuccagcggccaccugaagugccggcugaagauggacaagcuccgccugaaggggguguccuacagccugugcaccgccgccuucacguucaccaagauccccgcggagacccuccacggcaccgucaccguggaggugcaguacgccgggacggacggccccugcaaggucccggcccagauggccguggacaugcagacccugacccccgugggccggcugaucaccgccaaccccgucaucacggaguccaccgagaacagcaagaugaugcucgagcuggacccgcccuucggggacuccuacaucgugaucggcgugggggagaagaagaucacccaccacuggcaccgcagcggcagcaccaucgggaaggcguucgaggccacgguccggggcgccaagcgcauggccgugcugggcgacaccgccugggacuucggguccgugggcggggcgcucaacagccugggcaaggggauccaccagaucuucggcgccgccuucaagucccuguucggcgggaugagcugguucucccagauccugaucggcacccuccuggucuggcuggggcucaacaccaagaacggcagcaucucccugacgugccuggcccucgggggcgugcugaucuuccugagcaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7924 - RNA, 2290 nt, Artificial Sequence
  KU681082.3 prME-short mRNA Design 3 GC
gggagaaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcaugaacaagugcuacauccagaucauggaccuggggcacaugugcgacgccacgaugagcuacgagugcccgaugcuggacgagggcgucgagcccgacgacguggacugcuggugcaacaccaccuccaccuggguggucuacggcacgugccaccacaagaagggggaggcccggcgcagccggcgcgcggugacccuccccucccacagcacccggaagcugcagacccgcucccagacguggcuggagagccgggaguacaccaagcaccucauccgcguggagaacuggaucuuccggaaccccggcuucgcccuggccgccgcggucaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcccaggacaagcccaccguggacaucgagcuggugaccaccacggucuccaacauggcggaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgccaaguucgcgugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgccggcgcggacacggggacgccccacuggaacaacaaggaggcccugguggaguucaaggacgcccacgccaagcgccagaccguggucgugcucggcagccaggagggggccgugcacaccgcgcuggccggcgcccuggaggccgagauggacggggcgaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgccgggaccgacggccccugcaaggugccggcgcagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggagaagaagaucacccaccacuggcaccgcagcggcagcacgaucgggaaggccuucgaggccaccgugcggggcgcgaagcgcauggccgugcugggcgacaccgccugggacuucggguccgucggcggggcccucaacagccugggcaaggggauccaccagaucuucggcgccgcguucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7925 - RNA, 2290 nt, Artificial Sequence
  KX601167.1 prME-short mRNA Design 3 GC
gggagaaagcuuaccaugaccagcgugggcaucgucgggcugcuccugaccacggccauggccguggaggugacccgccggggcuccgcguacuacauguaccuggaccgcagcgacgccggggaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaccgggcacgagaccgacgagaaccgggccaagguggagaucacgccgaacagcccccgcgccgaggccacccucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacacggggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucaccuucaccaagauccccgccgagacccuccacggcaccgugacgguggagguccaguacgcggggaccgacggccccugcaaggugccggcccagauggccguggacaugcagacccugacccccgucggccggcugaucacggccaaccccgugaucaccgaguccaccgagaacagcaagaugaugcucgagcuggacccgcccuucggggacuccuacaucgugaucggcgucggggacaagaagaucacccaccacugguaccgcagcggcagcacgaucgggaaggccuucgaggcgaccgugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacacgaagaacggcagcaucucccugaccugccuggcccucgggggcgugcugaucuuccugagcaccgccgucuccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7926 - RNA, 2290 nt, Artificial Sequence
  KX694533.2 prME-short mRNA Design 3 GC
gggagaaagcuuaccaugaccagcgugggcaucgucgggcugcuccugaccacggccauggccguggaggugacccgccggggcuccgcguacuacauguaccuggaccgcagcgacgccgggaaggccaucuccuuccccaccacccucggcgucaacaagugcuacauccagaucauggaccuggggcacaugugcgacgccacgaugagcuacgagugcccgaugcuggacgagggcguggagcccgacgacguggacugcuggugcaacaccaccuccaccugggucguguacggcacgugccaccacaagaagggggaggcccggcgcagccggcgcgcggugacccuccccucccacagcacccggaagcugcagacccgcucccagacguggcuggagagccgggaguacaccaagcaccucauccgcgucgagaacuggaucuuccggaaccccggcuucgcccuggccgccgcggccaucgccuggcugcucggguccagcaccucccagaaggugaucuaccuggugaugauccugcucaucgccccggccuacagcauccgcugcaucggcgucuccaaccgggacuucguggaggggaugagcggcggcaccuggguggacgucgugcuggagcacgggggcugcgugacggucauggcgcaggacaagcccaccguggacaucgagcuggugaccaccacggucuccaacauggccgaggugcgcagcuacugcuacgaggccuccaucagcgacauggccagcgacucccggugccccacccagggggaggccuaccucgacaagcagagcgacacccaguacgugugcaagcgcacccuggucgaccggggcuggggcaacgggugcggccuguucgggaagggcucccucgugacgugcgcgaaguucgccugcagcaagaagaugaccgggaaguccauccagcccgagaaccuggaguaccgcaucaugcugagcguccacggcucccagcacagcggcaugaucgugaacgacaucgggcacgagaccgacgagaaccgggccaagguggagaucaccccgaacagcccccgcgccgaggccacgcucggcggguucggcucccuggggcuggacugcgagccccggaccggccucgacuucuccgaccuguacuaccugaccaugaacaacaagcacuggcucguccacaaggagugguuccacgacaucccccugccguggcacgcgggcgccgacaccgggacgccccacuggaacaacaaggaggcccugguggaguucaaggacgcccacgccaagcgccagaccguggucgugcucggcagccaggagggggcggugcacaccgcccuggccggcgcccuggaggcggagauggacggggccaagggccgccucuccagcggccaccugaagugccggcugaagauggacaagcuccgccugaagggggucuccuacagccugugcaccgccgccuucacguucaccaagauccccgccgagacccuccacggcaccgugaccguggagguccaguacgcggggacggacggccccugcaaggugccggcccagauggccguggacaugcagacccugacccccgucggccggcugaucaccgccaaccccgugaucacggaguccaccgagaacagcaagaugaugcucgagcuggacccgcccuucggggacuccuacaucgugaucggcgucggggacaagaagaucacccaccacuggcaccgcagcggcagcaccaucgggaaggccuucgaggcgacggugcggggcgccaagcgcauggccgugcugggcgacaccgccugggacuucggguccgucggcggggcccucaacagccugggcaaggggauccaccagaucuucggcgcggccuucaagucccuguucggcgggaugagcugguucucccagauccugaucggcacccuccugguguggcuggggcucaacaccaagaacggcagcaucucccugacgugccuggcccucgggggcgugcugaucuuccugagcaccgccgucuccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7927 - RNA, 2290 nt, Artificial Sequence
  KY288905.1 prME-short mRNA Design 3 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucacccugguggccgucgcgaucgccuggcugcucggguccagcaccucccagaaggugaucuaccuggugaugauccugcucaucgcccccgccuacagcauccggugcaucggcgucuccaaccgcgacuucguggaggggaugagcggcggcacguggguggacgucgugcuggagcacgggggcugcgugaccgucauggcccaggacaagccgaccguggacaucgagcuggugaccacgaccgucuccaacauggcggaggugcggagcuacugcuacgaggccuccaucagcgacauggccagcgacucccgcugccccacccagggggaggccuaccucgacaagcagagcgacacccaguacgugugcaagcggacgcuggucgaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgcgaagguggaggucacccccaacuccccgcgggccgaggccacccucggcggguucggcagccuggggcuggacugcgagccccgcacgggccucgacuucuccgaccuguacuaccugaccaugaacaacaagcacuggcucgugcacaaggagugguuccacgacaucccccugcccuggcacgccggcgccgacaccgggaccccgcacuggaacaacaaggaggcgcugguggaguucaaggacgcccacgccaagcggcagacggucguggugcucggcagccaggagggggccguccacaccgcccuggcgggcgcccuggaggccgagauggacggggccaagggccgccucuucuccggccaccugaagugccgccugaagauggacaagcuccggcugaagggggugagcuacucccugugcaccgcggccuucaccuucaccaaggugcccgccgagacgcuccacggcaccgucaccguggaggugcaguacgccgggaccgacggccccugcaagguccccgcccagauggcgguggacaugcagacgcugaccccggugggccgccugaucaccgccaaccccgucaucaccgagagcacggagaacuccaagaugaugcucgagcuggacccgcccuucggggacagcuacaucgugaucggcgugggggacaagaagaucacccaccacuggcaccgguccggcagcaccaucgggaaggccuucgaggccaccguccgcggcgccaagcggauggcggugcugggcgacacggccugggacuucgggagcgugggcggggucuucaacucccucggcaaggggauccaccagaucuucggcgccgccuucaagagccuguucggcgggauguccugguucagccagauccugaucggcacccugcucguguggcuggggcugaacaccaagaacggcuccaucagccugaccugccuggcccucgggggcgugaugaucuuccucuccacggcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7928 - RNA, 2290 nt, Artificial Sequence
  KF268950.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggggaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaaggucgaggugacccccaacuccccgcgggccgaggccacgcucggcggguucggcagccuggggcuggacugcgagccccgcaccggccucgacuucuccgaccuguacuaccugaccaugaacaacaagcacuggcucgugcacaaggagugguuccacgacaucccccugcccuggcacgcgggcgccgacaccgggacgccgcacuggaacaacaaggaggcccuggucgaguucaaggacgcccacgccaagcggcagaccguggugguccucggcagccaggagggggcggugcacaccgcccuggccggcgcccuggaggcggagauggacggggccaagggccgccucuucuccggccaccugaagugccgccugaagauggacaagcuccggcugaagggggugagcuacucccugugcaccgccgccuucacguucaccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaagggggugcaccagaucuucggcgccgcguucaagagccuguucggcgggauguccugguucagccagauccugaucggcacccugcucgucuggcuggggcugaacaccaagaacggcuccaucagccucacgugccuggcccugggcggcgugaugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7929 - RNA, 2290 nt, Artificial Sequence
  KF383121.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagcccgacgacguggacugcuggugcaacaccaccuccaccugggucguguacggcacgugccaccacaagaagggggaggcccggcgcagccggcgcgccgugacccuccccucccacagcacccggaagcugcagacccgcucccagacguggcuggagagccgggaguacaccaagcaccucaucaaggucgagaacuggaucuuccgcaaccccggcuucgcccugguggcgguggccaucgccuggcugcucggguccagcaccucccagaaggucaucuaccuggugaugauccugcucaucgcccccgccuacagcauccggugcaucggcguguccaaccgcgacuucgucgaggggaugagcggcggcaccuggguggacgugguccuggagcacgggggcugcgugacggugauggcgcaggacaagccgaccgucgacaucgagcuggugaccaccacgguguccaacauggccgagguccggagcuacugcuacgaggccuccaucagcgacauggccagcgacucccgcugccccacccagggggaggccuaccucgacaagcagagcgacacccaguacgugugcaagcggacccugguggaccgcggcuggggcaacgggugcggccuguucgggaagggcucccucgucacgugcgcgaaguucacgugcagcaagaagaugaccgggaaguccauccagcccgagaaccuggaguaccggaucaugcugagcgugcacggcucccagcacagcggcaugaucgucaacgacaucgggcacgagaccgacgagaaccgcgccaagguggaggugacccccaacuccccgcgggccgaggccacccucggcggguucggcagccuggggcuggacugcgagccccgcaccggccucgacuucuccgaccuguacuaccugaccaugaacaacaagcacuggcucguccacaaggagugguuccacgacaucccccugcccuggcacgccggcgcggacacggggaccccgcacuggaacaacaaggaggcccugguggaguucaaggacgcccacgccaagcggcagaccguggucgugcucggcagccaggagggggccgugcacaccgcgcuggccggcgcccuggaggccgagauggacggggcgaagggccgccucuucuccggccaccugaagugccgccugaagauggacaagcuccggcugaagggggucagcuacucccugugcacggccgccuucaccuucaccaaggugcccgccgagacccuccacggcaccgugacggucgaggugcaguacgccgggaccgacggccccugcaaggugcccgcgcagauggccgucgacaugcagacccugaccccggugggccgccugaucacggccaaccccgugaucaccgagagcaccgagaacuccaagaugaugcucgagcuggacccgcccuucggggacagcuacaucgucaucggcgugggggacaagaagaucacccaccacuggcaccgguccggcagcacgaucgggaaggccuucgaggccaccgugcgcggcgcgaagcggauggccguccugggcgacaccgccugggacuucgggagcgugggcgggguguucaacucccucggcaaggggauccaccagaucuucggcgccgccuucaagagccuguucggcgggauguccugguucagccagauccugaucggcacccugcucgucuggcuggggcugaacacgaagaacggcuccaucagccugaccugccuggcgcucgggggcgugaugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7930 - RNA, 2272 nt, Artificial Sequence
  KF268949.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccaaccucggcgugaacaagugccacguccagaucauggaccuggggcacaugugcgacgcgaccaugagcuacgagugccccaugcuggacgagggcguggagcccgacgacguggacugcuggugcaacacgaccuccaccugggucguguacgggaccugccaccacaagaagggcgaggcccggcgcagccggcgcgccgugacgcuccccucccacagcacccggaagcugcagacccgcucccagaccuggcuggagagccgggaguacacgaagcaccucaucaaggucgagaacuggaucuuccgcaaccccggcuucgcccuggcggccguggccaucgccuggcugcucggguccagcaccucccagaaggugaucuaccuggucaugauccugcucaucgcccccgcguacagcauccggugcaucggcguguccaaccgcgacuucguggaggggaugagcggcggcaccugggucgacguggugcuggagcacgggggcugcgucaccgugauggcccaggacaagccgacgguggacaucgagcuggucaccaccaccguguccaacauggccgaggugcggagcuacugcuacgaggccuccaucagcgacauggccagcgacucccgcugccccacgcagggggaggcguaccucgacaagcagagcgacacccaguacgucugcaagcggacccugguggaccgcggcuggggcaacgggugcggccuguucgggaagggcucccucgugaccugcgccaaguucacgugcagcaagaagaugaccgggaaguccauccagcccgagaaccuggaguaccggaucaugcugagcguccacggcucccagcacagcggcaugaucgugaacgacgagaaccgcgccaaggucgaggugacccccaacuccccgcgggccgaggccacccucgggggcuucgggagccugggccuggacugcgagccccgcacggggcucgacuucuccgaccuguacuaccugaccaugaacaacaagcacuggcucgugcacaaggagugguuccacgacaucccccugcccuggcacgcgggcgccgacaccggcaccccgcacuggaacaacaaggaggcccuggucgaguucaaggacgcccacgccaagcggcagacgguggugguccucgggagccaggagggcgcggugcacaccgcccuggccggggcccuggaggcggagauggacggcgccaaggggcgccucuucuccggccaccugaagugccgccugaagauggacaagcuccggcugaagggcgugagcuacucccugugcaccgccgccuucaccuucacgaagguccccgccgagacccuccacgggaccgugaccguggagguccaguacgcgggcaccgacgggcccugcaaggugcccgcccagauggccguggacaugcagacgcugaccccggucggccgccugaucaccgccaaccccgugaucaccgagagcacggagaacuccaagaugaugcucgagcuggacccgcccuucggcgacagcuacaucgugaucggggucggcgacaagaagaucacccaccacuggcaccgguccgggagcaccaucggcaaggccuucgaggcgaccgugcgcggggccaagcggauggccgugcugggcgacacggccugggacuucggcagcgucgggggcguguucaacucccucgggaagggcauccaccagaucuucggggccgcguucaagagccuguucggcggcauguccugguucagccagauccugaucgggacccugcucguguggcugggccugaacaccaagaacggguccaucagccugaccugccucgcccugggcggggucaugaucuuccucuccacggccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7931 - RNA, 2290 nt, Artificial Sequence
  KU955595.1 prME-short mRNA Design 3 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaccgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugacgaugaacaacaagcacuggcucgugcacaaggagugguuccacgacaucccccugcccuggcacgccggcgcggacaccgggaccccgcacuggaacaacaaggaggcccugguggaguucaaggacgcccacgccaagcggcagaccgucguggugcucggcagccaggagggggccguccacacggcgcuggccggcgcccuggaggccgagauggacggggcgaagggccgccucuucuccggccaccugaagugccgccugaagauggacaagcuccggcugaagggggugagcuacucccugugcaccgccgccuucaccuucaccaaggugcccgccgagacccuccacggcacggucaccguggaggugcaguacgccgggaccgacggccccugcaagguccccgcgcagauggccguggacaugcagacccugacgccggugggccgccugaucaccgccaaccccgucaucaccgagagcaccgagaacuccaagaugaugcucgagcuggacccgcccuucggggacagcuacaucgugaucggcgugggggacaagaagaucacgcaccacuggcaccgguccggcagcaccaucgggaaggccuucgaggccaccguccgcggcgcgaagcggauggccgugcugggcgacaccgccugggacuucgggagcgugggcggggucuucaacucccucggcaaggggauccaccagaucuucggcgccgccuucaagagccuguucggcgggauguccugguucagccagauccugaucggcacgcugcucguguggcuggggcugaacaccaagaacggcuccaucagccugaccugccuggcgcucgggggcgugaugaucuuccucuccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7932 - RNA, 2290 nt, Artificial Sequence
  KF383116.1 prME-short mRNA Design 3 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccagcacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacaucgggcacgagaccgacgagaaccgcgccaagguggaggucacccccaacuccccgcgggccgaggccacccucggcggguucggcagccuggggcuggacugcgagccccgcaccggccucgacuucuccgaccuguacuaccugaccaugaacaacaagcacuggcucgugcacaaggagugguuccacgacaucccccugcccuggcacgccggcgcggacacggggaccccgcacuggaacaacaaggaggcccugguggaguucaaggacgcccacgccaagcggcagaccgucguggugcucggcagccaggagggggccguccacaccgcgcuggccggcgcccuggaggccgagauggacggggcgaagggccgccucuucuccggccaccugaagugccgccugaagauggacaagcuccggcugaagggggugagcuacucccugugcacggccgugugcaccgccgccaagguccccgccgagacccuccacggcaccgugaccguggagguccaguacgcggggacggacggccccugcaaggugcccgcccagauggccguggacaugcagacccugaccccggucggccgccugaucaccgccaaccccgugaucacggagagcaccgagaacuccaagaugaugcucgagcuggacccgcccuucggggacagcuacaucgugaucggcgucggggacaagaagaucacccaccacuggcaccgguccggcagcaccaucgggaaggccuucgaggcgacggugcgcggcgccaagcggauggccgugcugggcgacaccgccugggacuucgggagcgucggcgggguguucaacucccucggcaaggggauccaccagaucuucggcgccgcguucaagagccuguucggcgggauguccugguucagccagauccugaucggcacccugcucguguggcuggggcugaacaccaagaacggcuccaucagccucacgugccuggcccucgggggcgucaugaucuuccuguccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7933 - RNA, 2272 nt, Artificial Sequence
  KX601166.1 prME-short mRNA Design 3 GC
gggagaaagcuuaccaugaccagcaucggcaucguggggcugcuccugaccacggccauggccgcggagaucacccgccggggcuccgccuacuacauguaccuggaccgcagcgacgccgggaaggccaucuccuucgccaccacccucggcgucaacaagugccacgugcagaucauggaccuggggcacaugugcgacgcgacgaugagcuacgagugccccaugcuggacgagggcguggagcccgacgacgucgacugcuggugcaacaccaccuccaccugggugguguacggcacgugccaccacaagaagggggaggcccggcgcagccggcgcgccgucacccuccccucccacagcacccggaagcugcagacccgcucccagacguggcuggagagccgggaguacaccaagcaccucaucaagguggagaacuggaucuuccgcaaccccggcuucgcccugguggcggucgccaucgccuggcugcucggguccagcaccucccagaaggugaucuaccuggugaugauccugcucaucgcccccgccuacagcauccggugcaucggcgucuccaaccgcgacuucguggaggggaugagcggcggcaccuggguggacgucgugcuggagcacgggggcugcgugacggucauggcgcaggacaagccgaccguggacaucgagcuggugaccaccacggucuccaacauggccgaggugcggagcuacugcuacgaggccuccaucagcgacauggccagcgacucccgcugccccacccagggggaggccuaccucgacaagcagagcgacacccaguacgugugcaagcggacccuggucgaccgcggcuggggcaacgggugcggccuguucgggaagggcucccucgugacgugcgcgaaguucacgugcagcaagaagaugaccgggaaguccauccagcccgagaaccuggaguaccggaucaugcugagcguccacggcucccagcacagcggcaugaucgugaacgacgagaaccgcgccaagguggaggucacccccaacuccccgcgggccgaggccacccucgggggcuucgggagccugggccuggacugcgagccccgcaccgggcucgacuucuccgaccuguacuaccugaccaugaacaacaagcacuggcucgugcacaaggagugguuccacgacaucccccugcccuggcacgccggcgcggacaccggcacgccgcacuggaacaacaaggaggcccugguggaguucaaggacgcccacgccaagcggcagaccgucguggugcucgggagccaggagggcgccguccacaccgcgcuggccggggcccuggaggccgagauggacggcgcgaaggggcgccucuucuccggccaccugaagugccgccugaagauggacaagcuccggcugaagggcgugagcuacucccugugcaccgccgccuucacguucaccaaggugcccgccgagacccuccacgggaccgucaccguggaggugcaguacgccggcacggacgggcccugcaagguccccgcgcagauggccguggacaugcagacccugaccccggugggccgccugaucaccgccaaccccgucaucacggagagcaccgagaacuccaagaugaugcucgagcuggacccgcccuucggcgacagcuacaucgugaucggggugggcgacaagaagaucacccaccacuggcaccgguccgggagcaccaucggcaaggccuucgaggccacgguccgcggggcgaagcggauggccgugcugggcgacaccgccugggacuucggcagcgucgggggcguguucaacucccucgggaagggcauccaccagaucuucggggccgccuucaagagccuguucggcggcauguccugguucagccagauccugaucgggacccugcucguguggcugggccugaacaccaagaacggguccaucagccucacgugccuggcgcugggcggggugaugaucuuccucuccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7934 - RNA, 2290 nt, Artificial Sequence
  KF383118.1 prME-short mRNA Design 3 GC
gggagaaagcuuaccaugaccagcaucggcaucaucgggcugcuccugaccacggccauggccgcggagaucacccgccggggcuccgccuacuacauguaccuggaccgcagcgacgccgggaaggccaucuccuucgccaccacccucggcgugaacaagugccacguccagaucauggaccuggggcacaugugcgacgcgacgaugagcuacgagugccccaugcuggacgagggcguggagccggacgacguggacugcuggugcaacaccaccuccaccugggucguguacggcacgugccaccacaagaagggggagacccggcgcagccggcgcuccgugagccuccgguaccacuacacccgcaagcugcagacccggucccagacguggcuggagagccgcgaguacaagaagcaccucaucauggucgagaacuggaucuuccggaaccccggcuucgccaucguguccguggccaucaccuggcugauggggagccugaccucccagaaggucaucuaccucgugaugaucgugcugaucguccccgccuacagcaucuccugcaucggcgugagcaaccgcgaccugguggaggggauguccggcggcaccugggucgacguggugcucgagcacgggggcugcgucacggagauggcgcaggacaagcccaccguggacaucgagcuggugaccaugaccgucagcaacauggccgaggugcgguccuacugcuacgaggccagccugagcgacauggccuccgccagccgcugcccgacgcagggggagcccucccucgacaagcagagcgacacccaguccgugugcaagcggacccugggcgaccgcggcugggggaacggcugcgggaucuucggcaaggggagccuggugaccugcuccaaguucacgugcugcaagaagaugcccggcaagagcauccagcccgagaaccucgaguaccggaucaugcugccggugcacggcucccagcacagcgggaugaucgucaacgacaucggccacgagaccgacgagaaccgcgcgaagguggaggugacccccaacagcccccgggccgaggccacccucgggggcuucgggucccugggccuggacugcgagccccgcacgggccuggacuucuccgaccucuacuaccugaccaugaacaacaagcacuggcugguccacaaggagugguuccacgacaucccgcuccccuggcacgccggggccgacaccggcacgccccacuggaacaacaaggaggcgcugguggaguucaaggacgcccacgccaagcggcagaccguggucgugcuggggagccaggagggcgccgugcacaccgcccucgcgggggcccuggaggccgagauggacggcgccaagggccgccuguucuccgggcaccucaagugccgccugaagauggacaagcugcggcucaagggcgucagcuacucccugugcaccgccgcguucaccuucacgaaggugcccgccgagacccugcacgggaccgugaccgucgaggugcagagcgccggcaccgacggcccgugcaaggugcccgcccagauggcggucgacaugcagacgcucacccccguggggcgccugaucaccgccaaccccgugaucaccgaguccacggagaacagcaagaugaugcuggagcucgacccgcccuucggcgacagcuacaucgucaucggggugggcgacaagaagaucacccaccacuggcaccgguccgggagcaccaucggcaaggccuucgaggccaccgugcgcggcgccaagcggauggcgguccugggggacacggccugggacuucggcuccgucgggggcguguucaacagccuggggaagggcauccaccagaucuucggcgccgccuucaagucccucuucgggggcaugagcugguucucccagauccugaucgggacccugcuggucuggcucggccugaacaccaagaacgggagcaucucccugaccugccucgcccugggcggcgugaugaucuuccugagcacggcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7935 - RNA, 2287 nt, Artificial Sequence
  KX447520.1 prME-short mRNA Design 3 GC
gggagaaagcuuaccaugagcgugggcaucgucgggcugcuccugaccaccgccauggccgcggaggugacgcgccggggcuccgccuacuacauguaccuggaccgcaacgacgccggggaggccaucagcuuccccaccacccucggcaugaacaagugcuacauccagaucauggaccuggggcacaugugcgacgccaccauguccuacgagugcccgaugcuggacgagggcguggagcccgacgacgucgacugcuggugcaacacgaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7936 - RNA, 2290 nt, Artificial Sequence
  KU761561.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgcccgccggauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7937 - RNA, 2290 nt, Artificial Sequence
  KX806557.2 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggauguuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggugauggcccaggacaagcccaccguggacaucgagcuggucaccaccacggugagcaacauggccgaggugcgcuccuacugcuacgaggccagcaucuccgacauggccagcgacagccggugccccacccagggggaggcguaccucgacaagcaguccgacacccaguacgucugcaagcgcacccugguggaccggggcuggggcaacgggugcggccuguucgggaagggcagccucgugacgugcgccaaguucgccugcuccaagaagaugaccggcaagagcauccagcccgagaaccuggaguaccgcaucaugcuguccguccacgggagccagcacuccggcaugaucgugaacgacaccgggcacgagaccgacgagaaccgggccaaggucgagaucacgccgaacagcccccgcgccgaggcgacccucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacacggggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucaccuucaccaagauccccgcggagacccuccacggcaccgugacggucgaggugcaguacgccgggaccgacggccccugcaaggugccggcccagauggccgucgacaugcagacccugacccccgugggccggcugaucacggccaaccccgugaucaccgagagcaccgagaacuccaagaugaugcucgagcuggacccgcccuucggggacagcuacaucgucaucggcgugggggagaagaagaucacccaccacuggcaccgcuccggcagcacgaucgggaaggcguucgaggccaccgugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacacgaagaacggcuccaucagccugaugugccuggcccucgggggcgugcugaucuuccuguccaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7938 - RNA, 2290 nt, Artificial Sequence
  LC191864.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaugaccagcaccugggugguguacgggaccugccaccacaagaagggggaggcgcggcgcucccggcgcgccgucacgcuccccagccacuccacccggaagcugcagacccgcagccagaccuggcuggagucccgggaguacacgaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucaccgugauggcccaggacaagcccacgguggacaucgagcuggucaccaccaccgugagcaacauggccgaggugcgcuccuacugcuacgaggccagcaucuccgacauggccagcgacagccggugccccacgcagggggaggcguaccucgacaagcaguccgacacccaguacgucugcaagcgcacccugguggaccggggcuggggcaacgggugcggccuguucgggaagggcagccucgugaccugcgccaaguucgccugcuccaagaagaugacgggcaagagcauccagcccgagaaccuggaguaccgcaucaugcuguccguccacggcagccagcacuccggcaugaucgugaacgacaccgggcacgagaccgacgagaaccgggccaaggucgagaucaccccgaacagcccccgcgccgaggcgacgcucggcggguucggcucccuggggcuggacugcgagccccggaccggccucgacuucagcgaccuguacuaccugaccaugaacaacaagcacuggcucgugcacaaggagugguuccacgacaucccccugccguggcacgccggcgccgacaccgggacgccccacuggaacaacaaggaggcccugguggaguucaaggacgcccacgcgaagcgccagaccgucguggugcucggcucccaggagggggccguccacaccgcccuggccggcgcgcuggaggccgagauggacggggccaagggccgccucagcuccggccaccugaagugccggcugaagauggacaagcuccgccugaagggggugagcuacucccugugcaccgccgccuucacguucaccaagauccccgcggagacccuccacggcaccgugaccgucgaggugcaguacgccgggacggacggccccugcaaggugccggcccagauggccgucgacaugcagacccugacccccgugggccggcugaucaccgccaaccccgugaucacggagagcaccgagaacuccaagaugaugcucgagcuggacccgcccuucggggacagcuacaucgucaucggcgugggggagaagaagaucacccaccacuggcaccgcuccggcagcaccaucgggaaggcguucgaggccacggugcggggcgccaagcgcauggccguccugggcgacaccgccugggacuucgggagcgugggcggggcgcucaacucccugggcaaggggauccaccagaucuucggcgccgccuucaagagccuguucggcgggauguccugguucagccagauccugaucggcacccuccugauguggcuggggcucaacaccaagaacggcuccaucagccugaugugccuggcccucgggggcgugcugaucuuccuguccacggcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7939 - RNA, 2290 nt, Artificial Sequence
  KU744693.1 prME-short mRNA Design 3 GC
gggagaaagcuuaccaugaccagcgugggcaucgucgggcugcuccugaccacggccauggccgcggaggugacccgccggggcuccgccuacuacauguaccuggaccgcaacgacgccggggaggccaucagcuuccccaccacccucggcaugaacaagugcuacauccagaucauggaccuggggcacaugugcgacgccacgauguccuacgagugcccgaugcuggacgagggcguggagcccgacgacgucgacugcuggugcaacaccaccagcaccugggugguguacggcacgugccaccacaagaagggggaggcgcggcgcucccggcgcgccgucacccuccccagccacuccacccggaagcugcagacccgcagccagacguggcuggagucccgggaguacaccaagcaccucauccgcguggagaacuggaucuuccggaaccccggcuucgcccuggccgcggccgccaucgccuggcugcucgggagcuccaccagccagaaggugaucuaccuggucaugauccugcucaucgccccggcguacuccauccgcugcaucggcgugagcaaccgggacuucguggaggggauguccggcggcaccugggucgacguggugcuggagcacgggggcugcgucacggccauggcccaggacaagcccaccguggacaucgagcuggugaccaccacggucagcaacauggccgaggugcgcuccuacugcuacgaggccagcaucuccgacauggcgagcgacagccggugccccacccagggggaggccuaccucgacaagcaguccgacacccaguacgugugcaagcgcacccuggucgaccggggcuggggcaacgggugcggccuguucgggaagggcagccucgugacgugcgccaaguucgccugcuccaagaagaugaccggcaagagcauccagcccgagaaccuggaguaccgcaucaugcuguccgugcacgggagccagcacuccggcaugcucgucaacgacaccgggcacgagaccgacgagaaccgggccaagguggagaucacgccgaacagcccccgcgcggaggccacccugggcggguucggcucccuggggcucgacugcgagccccggaccggccuggacuucagcgaccuguacuaccucaccaugaacaacaagcacuggcuggcccacaaggagugguuccacgacaucccccugccguggcacgccggcgccgcgacggggacgccccacuggaacaacaaggaggcccucgucgaguucaaggacgcccacgccaagcgccagaccguggugguccugggcucccaggagggggcggugcacaccgcccuggccggcgcccucgaggccgagauggacggggcgaagggccgccugagcuccggccaccugaagugccggcucaagauggacaagcugcgccugaagggggugagcuacucccucugcaccgccgccuucaccuucaccaagauccccgccgagaccgucgacggcaccgugacgguggaggggcaguacggcggcaccgacgggcccugcaaggucccggcccagauggcgguggacaugcagacccugacccccgugggccggcugaucacggccaaccccgucaucaccgagagcaccgagaacuccaagaugaugcucgagcuggacccgcccuucggggacagcuacaucgugaucggcgugggggagaagaagaucacccaccacuggcaccgcuccggcagcacgaucggcaaggccuucgaggccaccguccgcggggccaagcggauggcggugcugggcgacaccgccugggacuucgggagcgugggcggggcccucaacucccugggcaagggcauccaccagaucaucggggccgcguucaagagccuguucggcgggauguccugguucagccagauccugaucggcacccuccugauguggcuggggcucaacacgaagaacggcuccaucagccugaugugccuggcccucggcgggguccugaucuuccuguccaccgccgugagcggcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7940 - RNA, 2281 nt, Artificial Sequence
  KU963574.2 prME-short mRNA Design 3 GC
gggagaaagcuuaccaugggcgccgacgccagcaucgggaucgugucccugcuccugaccaccgucauggcggccgagaucacgcgccggggcagcgccuacuacauguaccuggaccgcuccgacgccgggaaggccaucagcuucgugaccacccucggcgugaacaagugccacguccagaucauggaccuggggcacaugugcgacgcgaccauguccuacgagugccccaugcuggacgagggcguggagcccgacgacguggacugcuggugcaacacgaccagcaccugggucguguacgggaccugccaccacaagaagggggaggcccggcgcucccggcgcgccgugacgcuccccagccacuccacccggaagcugcagacccgcagccagaccuggcuggagucccgggaguacacgaagcaccucaucaaggucgagaacuggaucuuccgcaaccccggcuucgcccugguggcgguggccaucgccuggcugcucgggagcuccaccagccagaaggucaucuaccuggugaugauccugcucaucgcccccgccuacuccauccggugcaucggcgugagcaaccgcgacuucgucgaggggauguccggcggcaccuggguggacgugguccuggagcacgggggcugcgugaccgugauggcgcaggacaagccgacggucgacaucgagcuggugaccaccaccgugagcaacauggccgagguccgguccuacugcuacgaggccagcaucagcgacauggccuccgacagccgcugccccacgcagggggaggccuaccucgacaagcaguccgacacccaguacgugugcaagcggacccuggucgaccgcggcuggggcaacgggugcggccuguucgggaagggcagccucgugaccugcgcgaaguucacgugcuccaagaagaugaccggcaagagcauccagcccgagaaccuggaguaccggaucaugcuguccgugcacggcagccagcacuccggcaugaucgucaacgacgagaaccgcgccaagguggaggugacccccaacagcccgcgggccgaggccacccucgggggcuucgggucccugggccuggacugcgagccccgcacggggcucgacuucagcgaccuguacuaccugaccaugaacaacaagcacuggcucguccacaaggagugguuccacgacaucccccugcccuggcacuccggcgccgacaccgagaccccgcacuggaacaacaaggaggcgcugguggaguucaaggacgcccacgccaagcggcagacgguggucgugcucggcagccaggagggggccgugcacaccgcccuggcgggcgcccuggaggccgagauggacggggccaagggccgccucuccagcgggcaccugaagugccgccugaagauggacaagcuccggcugaagggcgucuccuacagccugugcaccgcggccuucaccuucacgaaggugcccgccgagacccuccacggcaccgugaccgucgaggugcaguacgccgggcgcgacggccccugcaaggugcccgcccagauggcggucgacaugcagacccugacgccgguggggcggcugaucaccgccaaccccgugaucaccgaguccaccgagaacagcaagaugaugcucgagcuggacccgcccuucggcgacagcuacaucgucaucggcgugggggacaagaagaucacgcaccacuggcaccgcuccggcagcaucaucgggaaggccuucgaggccaccgugcggggcgccaagcgcauggcgguccugggggacaccgccugggacuucggcuccgugggcgggguguucaacagccucggcaaggggauccaccagaucuucggcgccgccuucaagucccuguucgggggcaugagcugguucucccagauccugaucggcacccugcucgucuggcuggggcugaacacgaagaacggcagcaucucccugaccugccuggcccucgggggcgugaugaucuuccucagcaccgcgguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7941 - RNA, 2299 nt, Artificial Sequence
  KF383120.1 prME-short mRNA Design 3 GC
gggagaaagcuuaccaugggcgccgacaccagcaucgggaucaucggccugcuccugaccacggccauggcggccgagaucacccgccggggguccgccuacuacauguaccuggaccgcagcgacgccggcaaggccaucuccuucgcgaccaccaugggggugaacaagugccacguccagaucauggaccucggccacaugugcgacgccacgaugagcuacgagugccccaugcuggacgagggcguggagccggacgacguggacugcuggugcaacaccaccuccaccugggucguguacgggacgugccaccacaagaagggcgaggcccggcccagccgccgggccgugacccugcccucccacagcacccgcaagcuccagacccggucccagacguggcuggagagccgcgaguacaccaagcaccugaucaaggucgagaacuggauccuccggaaccccggguucaccguggcggcccuggccauggccuggcugcucggcaacuccaccagccagcgcgugaucuaccuggucaugauccugcucaucgccccggcguacuccauccggugcaucggggugagcaaccgcgacuucguggagggcauguccggcgggacgugggucgacguggugcuggagcacggcgggugcgucaccgugauggcccaggacaagcccaccguggacaucgagcuggucaccacgaccgugagcaacauggccgaggugcgguccuacugcuacgaggccagcaucuccgacauggccagcgacagccgcugccccacccagggcgaggcguaccucgacaagcaguccgacacccaguacgucugcaagcggacgcugguggaccgcggcugggggaacggcugcgggcuguucggcaaggggagccucgugaccugcgccaaguucacgugcuccaagaagaugaccggcaagagcauccagcccgagaaccuggaguaccggaucaugcuguccguccacggcagccagcacuccgggaugaucgugaacgacaucggccacgagaccgacgagaaccgcgccaaggucgaggugaccccgaacagcccccgggccgaggccacccucgggggcuucgggucccugggccuggacugcgagccccgcaccggccucgacuucagcgaccuguacuaccugacgaugaacaacaagcacuggcucgugcacaaggagugguuccacgacaucccccugccguggcacgcgggggccgacaccggcacgccccacuggaacaacaaggaggcccuggucgaguucaaggacgcccacgccaagcggcagaccguggugguccucgggucccaggagggcgcggugcacaccgcccuggccggggcccuggaggcggagauggacggcgccaagggccgccucuucagcgggcaccugaagugccgcaucaagauggacaagcugcggcucaagggcguguccuacagccugugcaccgccgccuucaccuucuccaagguccccgccgagacccugcacgggaccgugacgguggagguccaguacgcgggccgcgacggccccugcaaggugccggcccagauggccguggacaugcagacccucacccccgucgggcggcugaucaccgccaaccccaucaucacggagagcaccgagaacucccgcaugaugcuggagcucgacccgcccuucggcgacagcuacaucgugaucggggugggcgacaagaagaucacccaccacuggcaccgguccgggagcaccaucggcaaggccuucgaggcgacgguccgcggcgccaagcggauggccgugcugggggacaccgccugggacuucggcagcgucgggggcguguucaacucccuggggaagggcgugcaccagguguucggcgccgcguucaagagccucuucgggggcauguccugguucagccagauccugaucgggacccugcuggucuggcucggccugaacaccaagaacggguccaucagccuggccugccucgcccugggcggcgccaugaucuuccuguccacggcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7942 - RNA, 1582 nt, Artificial Sequence; identical to SEQ ID NO: 7717
  KU321639.1 solE mRNA Design 3 GC

SEQ ID NO: 7943 - RNA, 1582 nt, Artificial Sequence; identical to SEQ ID NO: 7718
  KU312312.1 solE mRNA Design 3 GC

SEQ ID NO: 7944 - RNA, 1570 nt, Artificial Sequence; identical to SEQ ID NO: 7719
  AY632535.2 solE mRNA Design 3 GC

SEQ ID NO: 7945 - RNA, 1582 nt, Artificial Sequence; identical to SEQ ID NO: 7720
  KU527068.1 solE mRNA Design 3 GC

SEQ ID NO: 7946 - RNA, 1582 nt, Artificial Sequence
  KX421193.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7947 - RNA, 1582 nt, Artificial Sequence
  LC002520.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaccgugaacgacaucggcuacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggcaagcuguucagcgggcaccugaagugccggcucaagauggacaagcugcgccugaagggcguguccuacagccucugcacggccgccuucaccuucaccaagguccccgccgagacccugcacgggacggugaccguggagguccaguacgccggcaccgacggccccugcaagauccccgugcagauggcgguggacaugcagacccugacgccggucgggcggcucaucaccgccaaccccgugaucaccgaguccaccgagaacagcaagaugaugcuggagcuggacccgcccuucggcgacuccuacaucgugaucggggucggcgacaagaagaucacgcaccacuggcaccgcagcggguccaccaucggcaaggccuucgaggccaccgugcggggcgccaagcgcauggcggugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7948 - RNA, 1564 nt, Artificial Sequence
  DQ859059.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacgcgggcgccgacaccgggaccccgcacuggaacaacaaggaggcccucguggaguucaaggacgcccacgccaagcgccagacggucguggugcugggcagccaggagggggcgguccacaccgcccuggccggcgcccucgaggccgagauggacggcgcgaaggggcggcuguucagcggccaccugaagugccgccucaagauggacaagcugcggcugaaggggguguccuacagccucugcaccgccgccuucaccuucacgaagguccccgccgagacccugcacggcaccgugaccguggagguccaguacgccgggacggacggccccugcaaggugcccgcgcagauggccguggacaugcagacccugaccccggucggccgccucaucaccgccaaccccgugaucacggaguccaccgagaacagcaagaugaugcuggagcuggacccgcccuucggggacuccuacaucgugaucggcgucggggacaagaagaucacccaccacuggcaccggagcggcuccaccaucgggaaggccuucgaggccacggugcgcggcgcgaagcggauggccgugcucggcgacaccgccugggacuucgggagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7949 - RNA, 1570 nt, Artificial Sequence
  KU963573.2 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucggcuacgagaccgacgagaaccgggccaagguggaggugacccccaacuccccgcgcgccgaggccacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgcgggggccgacaccggcacgccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggcaagcuguucagcgggcaccugaagugccggcucaagauggacaagcugcgccugaagggcgucuccuacagccucugcaccgccgccuucacguucaccaaggugcccgccgagacccugcacgggaccgucacgguggaggugcaguacgccggcaccgacggccccugcaagauccccguccagauggcgguggacaugcagacccugaccccgguggggcggcucaucacggccaaccccgucaucaccgaguccaccgagaacagcaagaugaugcuggagcuggacccgcccuucggcgacuccuacaucgugaucggggugggcgacaagaagaucacccaccacuggcaccgcagcggguccacgaucggcaaggccuucgaggccaccguccggggcgccaagcgcauggcggugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7950 - RNA, 1582 nt, Artificial Sequence
  KY075939.1 solE mRNA Design 3 GC
gggagaaagcuuaccaugagccagaaggugaucuaccuggucaugauccuccugaucgcccccgccuacucccugcgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacuccccgcgcgccgaggcgacgcucgggggcuucggcagccuggggcuggacugcgagccccggaccggccuggacuucuccgaccucuacuaccugaccaugaacaacaagcacuggcugguccacaaggagugguuccacgacaucccccuccccuggcacgccggggccgacaccggcacgccgcacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagauccccgccgagacccugcacgggaccgugacggucgaggugcaguacgcgggcaccgacggccccugcaaggugcccgcccagauggccgucgacaugcagacccucaccccgguggggcgccugaucacggccaaccccgugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7951 - RNA, 1582 nt, Artificial Sequence
  KX447516.1 solE mRNA Design 3 GC
gggagaaagcuuaccaugagcaagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7952 - RNA, 1582 nt, Artificial Sequence
  KX447515.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacugguaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7953 - RNA, 1582 nt, Artificial Sequence
  KU758874.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggcaagcugagcuccgggcaccugaagugccggcucaagauggacaagcugcgccugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgagagcaccgagaacuccaagaugaugcuggagcuggacccgcccuucggcgacagcuacaucgucaucggggugggcgagaagaagaucacccaccacuggcaccgcuccgggagcacgaucggcaaggccuucgaggcgaccgugcggggcgccaagcgcauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7954 - RNA, 1582 nt, Artificial Sequence
  KU729218.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacacccagacccugacgccgguggggcgccucaucaccgccaaccccgugaucaccgagagcaccgagaacuccaagaugaugcuggagcuggacccgcccuucggcgacagcuacaucgucaucggggugggcgagaagaagaucacgcaccacuggcaccgguccgggagcaccaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7955 - RNA, 1582 nt, Artificial Sequence
  KU501217.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgagauccgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggagccaggagggcgccgugcacaccgcccuggccggcgcccucgaggcggagauggacggggccaagggccggcugagcuccgggcaccugaagugccgccucaagauggacaagcugcggcugaagggcgugagcuacucccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggccuucgaggcgaccgugcgcggcgccaagcggauggccgugcucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7956 - RNA, 1582 nt, Artificial Sequence
  KU761561.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgcccggcgcauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7957 - RNA, 1582 nt, Artificial Sequence
  KY075937.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggucagcgacucccggugccccacgcagggcgaggccuaccuggacaagcagagcgacacccaguacgugugcaagcgcacccugguggaccggggcugggggaacggcugcgggcuguucggcaaggggucccuggugaccugcgccaaguucgcgugcagcaagaagaugacgggcaaguccauccagcccgagaaccuggaguaccgcaucaugcucagcguccacggcucccagcacagcgggaugaucgugaacgacaccggccacgagaccgacgagaaccgggccaaggucgagaucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7958 - RNA, 1582 nt, Artificial Sequence
  KY014317.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaucgagaacuccaagaugaugcuggagcuggacccgcccuucggcgacagcuacaucgucaucggggugggcgagaagaagaucacccaccacuggcaccgguccgggagcaccaucggcaaggccuucgaggcgacggugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7959 - RNA, 1582 nt, Artificial Sequence
  KU870645.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucgggaucggcgagaagaagaucacccaccacuggcaccgguccgggagcacgaucggcaaggccuucgaggcgaccgugcgcggcgccaagcggauggccgugcucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7960 - RNA, 1582 nt, Artificial Sequence
  KU922923.1 solE mRNA Design 3 GC
gggagaaagcuuaccaugagccagaaggugaucuaccuggucaugauccuccugaucgcccuggccuacuccauccgcugcaucggcgugagcaaccgggacuucguggaggggauguccggcgggaccugggucgacguggugcucgagcacggcgggugcgucaccgugauggcgcaggacaagcccacgguggacaucgagcuggucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccucguggaccggggcugggggaacggcugcgggcuguucggcaaggggucccuggugaccugcgcgaaguucgccugcagcaagaagaugacgggcaaguccauccagcccgagaaccucgaguaccgcaucaugcugagcguccacggcucccagcacagcgggaugaucgugaacgacaccggccacgagaccgacgagaaccgggccaagguggagaucacccccaacagcccccgcgccgaggcgacgcucgggggcuucggcucccuggggcuggacugcgagccgcggaccggccuggacuucuccgaccucuacuaccugaccaugaacaacaagcacuggcugguccacaaggagugguuccacgacaucccccuccccuggcacgccggggccgacaccggcacgccccacuggaacaacaaggaggcccugguggaguucaaggacgcccacgcgaagcgccagaccguggucgugcuggggagccaggagggcgccgugcacaccgcccucgccggcgcccuggaggcggagauggacggggccaagggccggcugagcuccgggcaccucaagugccgccugaagauggacaagcugcggcucaagggcgucagcuacucccugugcaccgccgccuucacguucaccaagaucccggccgagacccugcacgggaccgugacggucgaggugcaguacgcgggcaccgacggccccugcaaggugcccgcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7961 - RNA, 1582 nt, Artificial Sequence
  KU497555.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggacccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcacggccgccuucaccuucaccaagauccccgccgagacccugcacgggacggugaccgucgaggugcaguacgcgggcaccgacggccccugcaaggugcccgcccagauggccgucgacaugcagacccugacgccgguggggcgccucaucaccgccaaccccgugaucaccgaguccaccgagaacagcaagaugaugcuggagcuggacccgcccuucggcgacuccuacaucgucaucggggugggcgagaagaagaucacgcaccacuggcaccggagcggguccaccaucggcaaggccuucgaggcgaccgugcgcggcgccaagcggauggccguccucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7962 - RNA, 1582 nt, Artificial Sequence
  KU312314.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcuggcccagauggccgucgacaugcagacccucacccccguggggcgccugaucacggccaacccggugaucaccgagagcaccgagaacuccaagaugaugcuggagcucgacccgcccuucggcgacagcuacaucgucaucggggugggcgagaagaagaucacccaccacuggcaccgguccgggagcacgaucggcaaggccuucgaggcgaccgugcgcggcgccaagcggauggccguccugggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7963 - RNA, 1582 nt, Artificial Sequence
  KY014314.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggaggcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgagaagaagaucacccaccacuggcaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7964 - RNA, 1582 nt, Artificial Sequence
  KX447517.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcggcccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7965 - RNA, 1582 nt, Artificial Sequence
  KU729217.2 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucagcaccaccguguccaacauggccgaggugcgcagcuacugcuacgaggccaccaucuccgacaucgccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccgccgugguccuggggagccaggagggcgccgugcacaccgcccuggccggcgcgcucgaggccgagauggacggggccaagggccggcugagcuccgggcaccugaagugccgccucaagauggacaagcugcggcugaagggcgugagcuacucccucugcaccgccgccuucacguucaccaagauccccgcggagacccugcacgggaccgucacgguggagguccaguacgccggcaccgacggccccugcaaggugcccgcccagauggccguggacaugcagacccugaccccggucgggcgccucaucacggccaaccccgugaucaccgagagcaccgagaacuccaagaugaugcuggagcuggacccgcccuucggcgacagcuacaucgugaucggggucggcgagaagaagaucacccaccacuggcaccgguccgggagcacgaucggcaaggcguucgaggccaccgugcgcggcgccaagcggauggccgugcucggggacaccgcgugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7966 - RNA, 1582 nt, Artificial Sequence
  KY328290.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucagcaagauccccgccgagacccugcacgggaccgugaccgaggagguccaguacgcgggcacggacggccccugcaaggugcccgcccagauggccguggacaugcagacccugaccccggucgggcgccucaucaccgccaaccccgugaucacggaguccaccgagaacagcaagaugaugcuggagcuggacccgcccuucggcgacuccuacaucgugaucggggucggcgagaagaagaucacccaccacuggcaccggagcggguccaccaucggcaaggccuucgaggcgacggugcgcggcgccaagcggauggccgugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7967 - RNA, 1582 nt, Artificial Sequence
  KX087101.3 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgagcugcaguacgcgggcaccgacggccccugcaaggugcccgcccagauggccguggacaugcagacccucaccccggucgggcgccugaucacggccaaccccgugaucaccgagagcaccgagaacuccaagaugaugcuggagcucgacccgcccuucggcgacagcuacaucgugaucggggucggcgagaagaagaucacccaccacuggcaccgguccgggagcacgaucggcaaggccuucgaggcgaccgugcgcggcgccaagcggauggccgugcugggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7968 - RNA, 1582 nt, Artificial Sequence
  KY003156.1 solE mRNA Design 3 GC
gggagaaagcuuaccaugagccagaaggugaucuaccuggucaugauccuccugaucgcccccgccuacuccauccgcugcaucggcaucagcaaccgggacuucguggaggggauguccggcgggaccuggguggacgucgugcuggagcacggcgggugcgugaccgucauggcgcaggacaagcccacgguggacaucgagcucgugaccaccaccgucagcaacauggccgaggugcgcuccuacugcuacgaggccagcaucuccgacauggccagcgacucccggugccccacgcagggcgaggccuaccuggacaagcagagcgacacccaguacgugugcaagcgcacccuggucgaccggggcugggggaacggcugcgggcuguucggcaaggggucccuggugaccugcgcgaaguucgccugcagcaagaagaugacgggcaaguccauccagcccgagaaccuggaguaccgcaucaugcucagcgugcacggcucccagcacagcgggaugaucgucaacgacaccggccacgagaccgacgagaaccgggccaagguggagaucacccccaacuccccgcgcgccgaggcgacgcucgggggcuucggcauccuggggcucgacugcgagccccggaccggccuggacuucagcgaccuguacuaccucaccaugaacaacaagcacuggcuggugcacaaggagugguuccacgacaucccccugcccuggcacgccggggccgacaccggcacgccgcacuggaacaacaaggaggcccucgucgaguucaaggacgcccacgcgaagcgccagaccguggugguccuggggucccaggagggcgccgugcacaccgcccuggccggcgcccucgaggcggagauggacggggccaagggccggcugagcagcgggcaccugaagugccgccucaagauggacaagcugcggcugaagggcguguccuacagccucugcaccgccgccuucacguucaccaagauccccgccgagacccugcacgggaccgucacgguggagguccaguacgcgggcaccgacggccccugcaaggugcccgcccagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgagaagaagaucacccaccacuggcaccggagcggguccacgaucggcaaggccuucgaggcgaccgugcgcggcgccaagcggauggccgugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7969 - RNA, 1582 nt, Artificial Sequence
  KU758876.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggucaagggccggcugagcuccgggcaccugaagugccgccucaagauggacaagcugcggcugaagggcgugagcuacucccucugcaccgccgccuucacguucaccaagauccccgccgagacccugcacgggaccgucacgguggaggugcaguacgccggcaccgacggccccugcaagguccccgcgcagauggccguggacaugcagacccugaccccgguggggcgccucaucacggccaaccccgucaucaccgagagcaccgagaacuccaagaugaugcuggagcuggacccgcccuucggcgacagcuacaucgugaucggggugggcgagaagaagaucacccaccacuggcaccgguccgggagcacgaucggcaaggccuucgaggccaccguccgcggcgcgaagcggauggccgugcucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7970 - RNA, 1582 nt, Artificial Sequence
  KU926310.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcgccgacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7971 - RNA, 1582 nt, Artificial Sequence
  KU681081.3 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacaccggggccgacacgggcaccccgcacuggaacaacaaggaggcccucguggaguucaaggacgcccacgccaagcgccagaccguggucgugcuggggagccaggagggcgcggugcacaccgcccuggccggcgcccucgaggccgagauggacggggcgaagggccggcugagcuccgggcaccugaagugccgccucaagauggacaagcugcggcugaagggcgucagcuacucccucugcacggccgccuucaccuucaccaagauccccgccgagacccugcacgggacggugaccgucgaggugcaguacgccggcaccgacggccccugcaaggugcccgcgcagauggccgucgacaugcagacccugacgccgguggggcgccucaucaccgccaaccccgugaucaccgagggcaccgagaacagcaagaugaugcuggagcuggacccgcccuucggggacuccuacaucgucaucggcgugggggagaagaagaucacgcaccacuggcaccggagcggcuccaccaucggcaaggccuucgaggccaccgugcgcggggcgaagcggauggccguccucggcgacaccgccugggacuucgggagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7972 - RNA, 1582 nt, Artificial Sequence
  KU744693.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgcgauggcccaggacaagcccacgguggacaucgagcucgugaccaccaccgucagcaacauggccgaggugcgcuccuacugcuacgaggccagcaucuccgacauggccagcgacucccggugccccacgcagggcgaggcguaccuggacaagcagagcgacacccaguacgugugcaagcgcacccuggucgaccggggcugggggaacggcugcgggcuguucggcaaggggucccuggugaccugcgccaaguucgccugcagcaagaagaugacgggcaaguccauccagcccgagaaccuggaguaccgcaucaugcucagcgugcacggcucccagcacagcgggaugcuggucaacgacaccggccacgagaccgacgagaaccgggccaagguggagaucacccccaacuccccgcgcgcggaggccacgcucgggggcuucggcagccucgggcuggacugcgagccccggaccggccuggacuucuccgaccucuacuaccugaccaugaacaacaagcacuggcuggcccacaaggagugguuccacgacaucccccuccccuggcacgccggggccgcgaccggcacgccgcacuggaacaacaaggaggcccugguggaguucaaggacgcccacgccaagcgccagaccgucguggugcuggggagccaggagggcgccguccacaccgcgcucgccggcgcccuggaggccgagauggacggggccaagggccggcugagcuccgggcaccucaagugccgccugaagauggacaagcugcggcucaagggcgugagcuacucccugugcaccgcggccuucacguucaccaagauccccgccgagaccguggacgggaccgucacgguggagggccaguacggcgggaccgacggccccugcaagguccccgcccagauggccguggacaugcagacccugaccccgguggggcgccucaucacggcgaaccccgucaucaccgagagcaccgagaacuccaagaugaugcuggagcuggacccgcccuucggcgacagcuacaucgugaucggggugggcgagaagaagaucacccaccacuggcaccgguccggcagcacgaucgggaaggccuucgaggccaccguccgcggcgccaagcggauggcggugcucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7973 - RNA, 1582 nt, Artificial Sequence
  EU545988.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccgccguggacaucgagcucgucacgaccaccgugagcaacauggccgaggugcgcuccuacugcuacgaggccagcaucuccgacauggccagcgacucccggugccccacccagggcgaggcguaccuggacaagcagagcgacacgcaguacgucugcaagcgcacccugguggaccggggcugggggaacggcugcgggcuguucggcaaggggucccuggugaccugcgccaaguucgccugcagcaagaagaugaccggcaaguccauccagcccgagaaccuggaguaccgcaucaugcucagcguccacggcucccagcacagcgggaugaucgugaacgacacgggccacgagaccgacgagaaccgggccaagguggagaucacccccaacuccccgcgcgcggaggccacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcgcacgccaagcgccagacgguggucgugcuggggagccaggagggcgccgugcacaccgcccuggccggcgcgcucgaggccgagauggacggggccaagggccggcugagcuccgggcaccugaagugccgccucaagauggacaagcugcggcugaagggcgucagcuacucccucugcaccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7974 - RNA, 1582 nt, Artificial Sequence
  KY007221.1 solE mRNA Design 3 GC
gggagaaagcuuaccaugagccagaaggugaucuaccuggucaugauccuccugaucgcccccgccuacuccauccgcugcaucggcgugaacaaccgggacuucguggaggggaugagcggcgggaccugggucgacguggugcuggagcacggcgggugcgucaccgugauggcgcaggacaagcccacgguggacaucgagcucgucaccaccaccguguccaacauggccgaggugcgcagcuacugcuacgaggccuccaucagcgacauggccuccgacagccggugccccacgcagggcgaggccuaccuggacaagcaguccgacacccaguacgucugcaagcgcacccugguggaccggggcugggggaacggcugcgggcuguucggcaaggggagccuggugaccugcgcgaaguucgccugcuccaagaagaugacgggcaagagcauccagcccgagaaccuggaguaccgcaucaugcucuccguccacggcagccagcacuccgggaugaucgugaacgacaccggccacgagaccgacgagaaccgggccaagguggagaucacccccaacagcccgcgcgccgaggcgacgcucgggggcuucggcucccuggggcucgacugcgagccccggaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggucccaggagggcgccgugcacaccgcccuggccggcgcccucgaggcggagauggacggggccaagggccggcugagcagcgggcaccugaagugccgccucaagauggacaagcugcggcugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgaguccaccgagaacagcaagaugaugcuggagcuggacccgcccuucggcgacuccuacaucgucaucggggugggcgagaagaagaucacccaccacuggcaccggagcggguccacgaucggcaaggccuucgaggcgaccgugcgcggcgccaagcggauggccguccucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7975 - RNA, 1582 nt, Artificial Sequence
  KY003152.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcgccgccgccuucaccuucacgaagauccccgcggagacccugcacgggaccgugaccgucgaggugcaguacgccggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgagaagaagaucacccaccacuggcaccgguccgggagcaccaucggcaaggcguucgaggccacggugcgcggcgccaagcggauggccguccucggggacaccgcgugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7976 - RNA, 1582 nt, Artificial Sequence
  KX694533.2 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaucggccacgagaccgacgagaaccgggccaagguggagaucacccccaacuccccgcgcgccgaggcgacccucgggggcuucggcagccuggggcucgacugcgagccccggacgggccuggacuucuccgaccuguacuaccucaccaugaacaacaagcacuggcugguccacaaggagugguuccacgacaucccccugcccuggcacgccggggccgacaccggcaccccgcacuggaacaacaaggaggcccucguggaguucaaggacgcccacgcgaagcgccagacgguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucaccuucacgaagauccccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggagagcaccgagaacuccaagaugaugcuggagcuggacccgcccuucggcgacagcuacaucgucaucggggugggcgacaagaagaucacccaccacuggcaccgguccgggagcaccaucggcaaggccuucgaggcgacggugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7977 - RNA, 1582 nt, Artificial Sequence
  KX601167.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucgccugcagcaagaagaugacgggcaaguccauccagcccgagaaccuggaguaccgcaucaugcucagcguccacggcucccagcacagcgggaugaucgugaacgacaccggccacgagaccgacgagaaccgggccaagguggagaucacccccaacuccccgcgcgccgaggcgacgcucgggggcuucggcagccuggggcucgacugcgagccccggaccggccuggacuucuccgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcgccagaccguggucgugcuggggagccaggagggcgccgugcacaccgcccuggccggcgcccucgaggcggagauggacggggccaagggccggcugagcuccgggcaccugaagugccgccucaagauggacaagcugcggcugaagggcgucagcuacucccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcgccucaucacggccaaccccgugaucaccgagagcaccgagaacuccaagaugaugcuggagcuggacccgcccuucggcgacagcuacaucgucaucggggugggcgacaagaagaucacccaccacugguaccgguccgggagcacgaucggcaaggccuucgaggcgaccgugcgcggcgccaagcggauggccguccucggggacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7978 - RNA, 1582 nt, Artificial Sequence
  KY288905.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaccggccacgagaccgacgagaaccgggccaagguggaggucacgcccaacuccccgcgcgccgaggccacccucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacacgggcaccccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcacggccgccuucaccuucaccaagguccccgccgagacccugcacgggacggugaccguggagguccaguacgccggcaccgacggccccugcaaggugcccgcgcagauggccguggacaugcagacccugacgccggucgggcgccucaucaccgccaaccccgugaucaccgaguccaccgagaacagcaagaugaugcuggagcuggacccgcccuucggcgacuccuacaucgugaucggggucggcgacaagaagaucacgcaccacuggcaccggagcggguccaccaucggcaaggccuucgaggccaccgugcgcggcgcgaagcggauggccgugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7979 - RNA, 1582 nt, Artificial Sequence
  KF268950.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgccuucacguucaccaagguccccgccgagacccugcacgggaccgugacgguggagguccaguacgccggcaccgacggccccugcaaggugcccgcgcagauggccguggacaugcagacccugaccccggucgggcgccucaucacggccaaccccgugaucaccgaguccaccgagaacagcaagaugaugcuggagcuggacccgcccuucggcgacuccuacaucgugaucggggucggcgacaagaagaucacccaccacuggcaccggagcggguccacgaucggcaaggccuucgaggccaccgugcgcggcgcgaagcggauggccgugcucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7980 - RNA, 1582 nt, Artificial Sequence
  KF383116.1 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcgggcuguucggcaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacaucggccacgagaccgacgagaaccgggccaagguggaggucacccccaacuccccgcgcgccgaggccacgcucgggggcuucggcagccuggggcucgacugcgagccccggaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcgccagaccgucguggugcuggggagccaggagggcgcgguccacaccgcccuggccggcgcccucgaggccgagauggacggggcgaagggccggcuguucagcgggcaccugaagugccgccucaagauggacaagcugcggcugaagggcguguccuacagccucugcaccgccgucugcacggccgccaaggugcccgccgagacccugcacgggaccgugaccgucgaggugcaguacgcgggcacggacggccccugcaaggugcccgcccagauggccgucgacaugcagacccugaccccgguggggcgccucaucaccgccaaccccgugaucacggaguccaccgagaacagcaagaugaugcuggagcuggacccgcccuucggcgacuccuacaucgucaucggggugggcgacaagaagaucacccaccacuggcaccggagcggguccaccaucggcaaggccuucgaggcgacggugcgcggcgccaagcggauggccguccucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7981 - RNA, 1564 nt, Artificial Sequence
  KU963574.2 solE mRNA Design 3 GC
gggagaaagcuuaccaugagccagaaggugaucuaccuggucaugauccuccugaucgcccccgccuacuccauccgcugcaucggcgugagcaaccgggacuucguggaggggauguccggcgggaccugggucgacguggugcuggagcacggcgggugcgucaccgugauggcgcaggacaagcccacgguggacaucgagcucgucaccaccaccgugagcaacauggccgaggugcgcuccuacugcuacgaggccagcaucuccgacauggccagcgacucccggugccccacgcagggcgaggccuaccuggacaagcagagcgacacccaguacgucugcaagcgcacccugguggaccggggcugggggaacggcugcggccucuucgggaaggggucccuggugaccugcgcgaaguucacgugcagcaagaagaugaccggcaaguccauccagcccgagaaccuggaguaccgcaucaugcucagcguccacggcucccagcacagcgggaugaucgugaacgacgagaaccgggccaagguggaggucacccccaacuccccgcgcgccgaggccacccugggcggguucggcagccugggccucgacugcgagccccggacggggcuggacuucuccgaccuguacuaccucaccaugaacaacaagcacuggcuggugcacaaggagugguuccacgacaucccccugcccuggcacagcggcgcggacaccgagaccccgcacuggaacaacaaggaggcccucguggaguucaaggacgcccacgccaagcgccagacggucguggugcuggggagccaggagggcgccguccacaccgcgcuggccggggcccucgaggccgagauggacggcgccaagggccggcuguccagcgggcaccugaagugccgccucaagauggacaagcugcggcugaagggcguguccuacagccucugcaccgcggccuucaccuucacgaagguccccgccgagacccugcacgggaccgugaccguggagguccaguacgccggccgcgacgggcccugcaaggugcccgcccagauggcgguggacaugcagacgcugaccccggucggccggcucaucaccgccaaccccgugaucaccgaguccacggagaacagcaagaugaugcuggagcuggacccgcccuucggcgacuccuacaucgugaucggggucggcgacaagaagaucacccaccacuggcaccgcagcggguccaucaucggcaaggccuucgaggccaccgugcgcggggccaagcggauggcggugcucggcgacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7982 - RNA, 1582 nt, Artificial Sequence
  KF383118.1 solE mRNA Design 3 GC
gggagaaagcuuaccaugagccagaaggugaucuaccuggucaugaucgugcucaucgugcccgccuacuccaucagcugcaucggcgucuccaaccgcgaccugguggaggggaugagcggcgggaccuggguggacgucgugcuggagcacggcgggugcgugaccgagauggcccaggacaagcccacggucgacaucgagcucgugaccaugaccguguccaacauggcggagguccggagcuacugcuacgaggccucccugagcgacauggccuccgccagccgcugccccacccagggcgagcccucccuggacaagcagagcgacacgcaguccgugugcaagcggacccucggcgaccgcggguggggcaacgggugcggcaucuucgggaagggcagccuggugaccugcuccaaguucacgugcugcaagaagaugcccggcaagagcauccagccggagaaccuggaguaccggaucaugcuccccguccacgggucccagcacagcggcaugaucgugaacgacaucgggcacgagaccgacgagaaccgcgccaagguggaggucacccccaacagcccccgggcggaggccacccugggcggcuucgggucccugggccucgacugcgagccgcgcaccgggcuggacuucagcgaccuguacuaccucacgaugaacaacaagcacuggcuggugcacaaggagugguuccacgacaucccccugcccuggcacgccggcgccgacaccgggacgccccacuggaacaacaaggaggcgcucguggaguucaaggacgcccacgccaagcggcagaccgucguggugcugggcucccaggagggcgccguccacaccgcccuggcgggggcccucgaggccgagauggacggcgccaaggggcgccuguucagcggccaccugaagugccggcucaagauggacaagcugcgccugaaggggguguccuacagccucugcaccgccgcguucaccuucaccaaggucccggccgagacgcugcacggcaccgugaccguggagguccaguccgccggcaccgacgggcccugcaaggugcccgcccagauggccguggacaugcagacgcugacccccgucggccggcucaucaccgcgaacccggugaucaccgagagcacggagaacuccaagaugaugcuggagcuggacccgcccuucggggacagcuacaucgugaucggcgucggggacaagaagaucacccaccacuggcaccgcuccggcagcaccaucggcaaggccuucgaggccaccgugcgcggggccaagcggauggccgugcucggcgacacggcgugggacuucggguccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7983 - RNA, 1582 nt, Artificial Sequence
  KX520666.1 solE mRNA Design 3 GC
gggagaaagcuuaccaugcgccagaaggugaucuaccuggucaugauccuccugaucgcccccgccuacagcauccggugcaucggcguguccaaccgcgacuucguggaggggaugagcggcgggaccugggucgacguggugcuggagcacggcgggugcgucaccgugauggcgcaggacaagcccacgguggacaucgagcucgucaccaccaccguguccaacauggccgaggugcggagcuacugcuacgaggccuccaucagcgacauggccuccgacagccgcugccccacgcagggcgaggccuaccuggacaagcaguccgacacccaguacgucugcaagcggacccugguggaccgcggcugggggaacggcugcgggcuguucggcaaggggagccuggugaccugcgcgaaguucgccugcuccaagaagaugacgggcaagagcauccagcccgagaaccuggaguaccggaucaugcucuccguccacggcagccagcacuccgggaugaucgugaacgacaccggccacgagaccgacgagaaccgcgccaagguggagaucacccccaacagcccgcgggccgaggcgacgcucgggggcuucggcucccuggggcucgacugcgagccccgcaccggccuggacuucagcgaccuguacuaccucaccaugaacaacaagcacuggcugguccacaaggagugguuccacgacaucccccugcccuggcacgccggggccgacaccggcacgccgcacuggaacaacaaggaggcccucguggaguucaaggacgcccacgcgaagcggcagaccguggucgugcuggggucccaggagggcgccgugcacaccgcccuggccggcgcccucgaggcggagauggacggggccaagggccgccugagcagcgggcaccugaagugccggcucaagauggacaagcugcgccugaagggcgucuccuacagccucugcaccgccgccuucacguucaccaagauccccgccgagacccugcacgggaccgugacggucgaggugcaguacgcgggcaccgacggccccugcaaggugcccgcccagauggccgucgacaugcagacccugaccccgguggggcggcucaucacggccaaccccgugaucaccgaguccaccgagaacagcaagaugaugcuggagcuggacccgcccuucggcgacuccuacaucgucaucggggugggcgagaagaagaucacccaccacuggcaccgcagcggguccacgaucggcaaggccuucgaggcgaccgugcggggcgccaagcgcauggccguccucggggacaccgccugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7984 - RNA, 1582 nt, Artificial Sequence
  KF383120.1 solE mRNA Design 3 GC
gggagaaagcuuaccaugagccagcgcgugaucuaccuggucaugauccuccugaucgcccccgccuacuccauccggugcaucggcgugagcaaccgcgacuucguggaggggauguccggcgggaccugggucgacguggugcuggagcacggcgggugcgucaccgugauggcgcaggacaagcccacgguggacaucgagcucgucaccaccaccgugagcaacauggccgaggugcgguccuacugcuacgaggccagcaucuccgacauggccagcgacucccgcugccccacgcagggcgaggccuaccuggacaagcagagcgacacccaguacgucugcaagcggacccugguggaccgcggcugggggaacggcugcgggcuguucggcaaggggucccuggugaccugcgcgaaguucacgugcagcaagaagaugaccggcaaguccauccagcccgagaaccuggaguaccggaucaugcucagcguccacggcucccagcacagcgggaugaucgugaacgacaucggccacgagaccgacgagaaccgcgccaagguggaggucacccccaacuccccgcgggccgaggccacgcucgggggcuucggcagccuggggcucgacugcgagccccgcaccggccuggacuucuccgaccuguacuaccucaccaugaacaacaagcacuggcuggugcacaaggagugguuccacgacaucccccugcccuggcacgcgggggccgacaccggcacgccgcacuggaacaacaaggaggcccucguggaguucaaggacgcccacgccaagcggcagaccgucguggugcuggggagccaggagggcgcgguccacaccgcccuggccggcgcccucgaggccgagauggacggggcgaagggccgccuguucagcgggcaccugaagugccggaucaagauggacaagcuccgccugaagggcguguccuacagccugugcaccgccgccuucacguucuccaagguccccgccgagacccuccacgggaccgugaccguggagguccaguacgccggccgggacggccccugcaaggugcccgcgcagauggccguggacaugcagacgcugaccccggucgggcgccugaucaccgccaaccccaucaucaccgagagcacggagaacucccggaugaugcucgagcuggacccgcccuucggcgacagcuacaucgugaucggggugggcgacaagaagaucacccaccacuggcaccgcuccgggagcaccaucggcaaggccuucgaggccaccguccggggcgcgaagcgcauggccgugcugggggacacggccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7985 - RNA, 2365 nt, Artificial Sequence
  ZIKV (strain ZikaSPH2015) Polyprotein(93-804) mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7986 - RNA, 2365 nt, Artificial Sequence
  ZIKV (isolate Z1106033) Polyprotein(93-804) mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7987 - RNA, 2353 nt, Artificial Sequence
  ZIKV (strain MR 766) Polyprotein(93-800) mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7988 - RNA, 2365 nt, Artificial Sequence
  ZIKV (strain NatalRGN) Polyprotein(93-804) mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7989 - RNA, 2290 nt, Artificial Sequence
  ZIKV (strain ZikaSPH2015) Polyprotein(108-794) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7990 - RNA, 2290 nt, Artificial Sequence
  ZIKV (isolate Z1106033) Polyprotein(108-794) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7991 - RNA, 2278 nt, Artificial Sequence
  ZIKV (strain MR 766) Polyprotein(108-790) mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7992 - RNA, 2290 nt, Artificial Sequence
  ZIKV (strain NatalRGN) Polyprotein(108-794) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7993 - RNA, 1582 nt, Artificial Sequence
  ZIKV (strain ZikaSPH2015) Polyprotein(273-723) mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7994 - RNA, 1582 nt, Artificial Sequence
  ZIKV (isolate Z1106033) Polyprotein(273-723) mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7995 - RNA, 1570 nt, Artificial Sequence
  ZIKV (strain MR 766) Polyprotein(273-719) mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7996 - RNA, 1582 nt, Artificial Sequence; identical to SEQ ID NO: 7994
  ZIKV (strain NatalRGN) Polyprotein(273-723) mRNA Design 3 opt

SEQ ID NO: 7997 - RNA, 2290 nt, Artificial Sequence
  ZIKV (strain ZikaSPH2015) Polyprotein(108-794)(F398S) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7998 - RNA, 2290 nt, Artificial Sequence
  ZIKV (isolate Z1106033) Polyprotein(108-794)(F398S) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 7999 - RNA, 2278 nt, Artificial Sequence
  ZIKV (strain MR 766) Polyprotein(108-790)(F398S) mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8000 - RNA, 2290 nt, Artificial Sequence
  ZIKV (strain NatalRGN) Polyprotein(108-794)(F399S) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuccggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8001 - RNA, 2290 nt, Artificial Sequence
  ZIKV (strain ZikaSPH2015) Polyprotein(108-794)(N444Q) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8002 - RNA, 2290 nt, Artificial Sequence
  ZIKV (isolate Z1106033) Polyprotein(108-794)(N444Q) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8003 - RNA, 2290 nt, Artificial Sequence
  ZIKV (strain NatalRGN) Polyprotein(108-794)(N444Q) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucguccaggacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8004 - RNA, 2290 nt, Artificial Sequence
  ZIKV (strain ZikaSPH2015) Polyprotein(108-694)-Cterm-JAEV1-E(400-500) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8005 - RNA, 2290 nt, Artificial Sequence
  ZIKV (isolate Z1106033) Polyprotein(108-694)-Cterm-JAEV1-E(400-500) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8006 - RNA, 2278 nt, Artificial Sequence
  ZIKV (strain MR 766) Polyprotein(108-690)-Cterm-JAEV1-E(400-500) mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8007 - RNA, 2290 nt, Artificial Sequence
  ZIKV (strain NatalRGN) Polyprotein(108-694)-Cterm-JAEV1-E(400-500) mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8008 - RNA, 2365 nt, Artificial Sequence; identical to SEQ ID NO: 7985
  ZIKV (strain ZikaSPH2015) Polyprotein(93-804) mRNA Design 3 opt

SEQ ID NO: 8009 - RNA, 2362 nt, Artificial Sequence
  ZIKV prME variant mRNA Design 3 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8010 - RNA, 2359 nt, Artificial Sequence
  ZIKV prME variant mRNA Design 3 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8011 - RNA, 2356 nt, Artificial Sequence
  ZIKV prME variant mRNA Design 3 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8012 - RNA, 2353 nt, Artificial Sequence
  ZIKV prME variant mRNA Design 3 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8013 - RNA, 2350 nt, Artificial Sequence
  ZIKV prME variant mRNA Design 3 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8014 - RNA, 2347 nt, Artificial Sequence
  ZIKV prME variant mRNA Design 3 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8015 - RNA, 2344 nt, Artificial Sequence
  ZIKV prME variant mRNA Design 3 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8016 - RNA, 2341 nt, Artificial Sequence
  ZIKV prME variant mRNA Design 3 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8017 - RNA, 2338 nt, Artificial Sequence
  ZIKV prME variant mRNA Design 3 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8018 - RNA, 2335 nt, Artificial Sequence
  ZIKV prME variant mRNA Design 3 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8019 - RNA, 2332 nt, Artificial Sequence
  ZIKV prME variant mRNA Design 3 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8020 - RNA, 2329 nt, Artificial Sequence
  ZIKV prME variant mRNA Design 3 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8021 - RNA, 2326 nt, Artificial Sequence
  ZIKV prME variant mRNA Design 3 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8022 - RNA, 2323 nt, Artificial Sequence
  ZIKV prME variant mRNA Design 3 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8023 - RNA, 2320 nt, Artificial Sequence
  ZIKV prME variant mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8024 - RNA, 2320 nt, Artificial Sequence
  ZIKV prME variant mRNA Design 3 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8025 - RNA, 2332 nt, Artificial Sequence
  ZIKV prME variant mRNA Design 3 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8026 - RNA, 2356 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8027 - RNA, 2356 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8028 - RNA, 2347 nt, Artificial Sequence
  ZIKV prME variant mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8029 - RNA, 2344 nt, Artificial Sequence
  ZIKV prME variant mRNA Design 3 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8030 - RNA, 2341 nt, Artificial Sequence
  ZIKV prME variant mRNA Design 3 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8031 - RNA, 2338 nt, Artificial Sequence
  ZIKV prME variant mRNA Design 3 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8032 - RNA, 2335 nt, Artificial Sequence
  ZIKV prME variant mRNA Design 3 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8033 - RNA, 2332 nt, Artificial Sequence
  ZIKV prME variant mRNA Design 3 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8034 - RNA, 2329 nt, Artificial Sequence
  ZIKV prME variant mRNA Design 3 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8035 - RNA, 2326 nt, Artificial Sequence
  ZIKV prME variant mRNA Design 3 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8036 - RNA, 2323 nt, Artificial Sequence
  ZIKV prME variant mRNA Design 3 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8037 - RNA, 2320 nt, Artificial Sequence
  ZIKV prME variant mRNA Design 3 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8038 - RNA, 2317 nt, Artificial Sequence
  ZIKV prME variant mRNA Design 3 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8039 - RNA, 2314 nt, Artificial Sequence
  ZIKV prME variant mRNA Design 3 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8040 - RNA, 2311 nt, Artificial Sequence
  ZIKV prME variant mRNA Design 3 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8041 - RNA, 2308 nt, Artificial Sequence
  ZIKV prME variant mRNA Design 3 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8042 - RNA, 2305 nt, Artificial Sequence
  ZIKV prME variant mRNA Design 3 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8043 - RNA, 2302 nt, Artificial Sequence
  ZIKV prME variant mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8044 - RNA, 2302 nt, Artificial Sequence
  ZIKV prME variant mRNA Design 3 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8045 - RNA, 2314 nt, Artificial Sequence
  ZIKV prME variant mRNA Design 3 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8046 - RNA, 2338 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8047 - RNA, 2338 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8048 - RNA, 2338 nt, Artificial Sequence
  ZIKV prME variant mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8049 - RNA, 2335 nt, Artificial Sequence
  ZIKV prME variant mRNA Design 3 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8050 - RNA, 2332 nt, Artificial Sequence
  ZIKV prME variant mRNA Design 3 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8051 - RNA, 2329 nt, Artificial Sequence
  ZIKV prME variant mRNA Design 3 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8052 - RNA, 2326 nt, Artificial Sequence
  ZIKV prME variant mRNA Design 3 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8053 - RNA, 2323 nt, Artificial Sequence
  ZIKV prME variant mRNA Design 3 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8054 - RNA, 2320 nt, Artificial Sequence
  ZIKV prME variant mRNA Design 3 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8055 - RNA, 2317 nt, Artificial Sequence
  ZIKV prME variant mRNA Design 3 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8056 - RNA, 2314 nt, Artificial Sequence
  ZIKV prME variant mRNA Design 3 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8057 - RNA, 2311 nt, Artificial Sequence
  ZIKV prME variant mRNA Design 3 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8058 - RNA, 2308 nt, Artificial Sequence
  ZIKV prME variant mRNA Design 3 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8059 - RNA, 2305 nt, Artificial Sequence
  ZIKV prME variant mRNA Design 3 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8060 - RNA, 2302 nt, Artificial Sequence
  ZIKV prME variant mRNA Design 3 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8061 - RNA, 2299 nt, Artificial Sequence
  ZIKV prME variant mRNA Design 3 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8062 - RNA, 2296 nt, Artificial Sequence
  ZIKV prME variant mRNA Design 3 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8063 - RNA, 2293 nt, Artificial Sequence
  ZIKV prME variant mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8064 - RNA, 2293 nt, Artificial Sequence
  ZIKV prME variant mRNA Design 3 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8065 - RNA, 2305 nt, Artificial Sequence
  ZIKV prME variant mRNA Design 3 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8066 - RNA, 2329 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8067 - RNA, 2329 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8068 - RNA, 2335 nt, Artificial Sequence
  ZIKV prME variant mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8069 - RNA, 2329 nt, Artificial Sequence
  ZIKV prME variant mRNA Design 3 opt
gggagaaagcuuaccaugaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8070 - RNA, 2332 nt, Artificial Sequence
  ZIKV prME variant mRNA Design 3 opt
gggagaaagcuuaccaugaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8071 - RNA, 2326 nt, Artificial Sequence
  ZIKV prME variant mRNA Design 3 opt
gggagaaagcuuaccaugaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8072 - RNA, 2323 nt, Artificial Sequence
  ZIKV prME variant mRNA Design 3 opt
gggagaaagcuuaccauggcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8073 - RNA, 2320 nt, Artificial Sequence
  ZIKV prME variant mRNA Design 3 opt
gggagaaagcuuaccaugcgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8074 - RNA, 2317 nt, Artificial Sequence
  ZIKV prME variant mRNA Design 3 opt
gggagaaagcuuaccaugaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8075 - RNA, 2314 nt, Artificial Sequence
  ZIKV prME variant mRNA Design 3 opt
gggagaaagcuuaccauggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8076 - RNA, 2311 nt, Artificial Sequence
  ZIKV prME variant mRNA Design 3 opt
gggagaaagcuuaccaugaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8077 - RNA, 2308 nt, Artificial Sequence
  ZIKV prME variant mRNA Design 3 opt
gggagaaagcuuaccaugaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8078 - RNA, 2305 nt, Artificial Sequence
  ZIKV prME variant mRNA Design 3 opt
gggagaaagcuuaccaugcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8079 - RNA, 2302 nt, Artificial Sequence
  ZIKV prME variant mRNA Design 3 opt
gggagaaagcuuaccaugcgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8080 - RNA, 2299 nt, Artificial Sequence
  ZIKV prME variant mRNA Design 3 opt
gggagaaagcuuaccaugggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8081 - RNA, 2296 nt, Artificial Sequence
  ZIKV prME variant mRNA Design 3 opt
gggagaaagcuuaccauggccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8082 - RNA, 2293 nt, Artificial Sequence
  ZIKV prME variant mRNA Design 3 opt
gggagaaagcuuaccauggacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8083 - RNA, 2290 nt, Artificial Sequence; identical to SEQ ID NO: 7989
  ZIKV (strain ZikaSPH2015) Polyprotein(108-794) mRNA Design 3 opt

SEQ ID NO: 8084 - RNA, 2290 nt, Artificial Sequence
  ZIKV prME variant mRNA Design 3 opt
gggagaaagcuuaccaugaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8085 - RNA, 2302 nt, Artificial Sequence
  ZIKV prME variant mRNA Design 3 opt
gggagaaagcuuaccaugcgcggcgccgacaccuccgucggcaucgucggccuccuccucaccaccgccauggccgccgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8086 - RNA, 2326 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcggcgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8087 - RNA, 2326 nt, Artificial Sequence
  ZIKV prME variant mRNA Design 3 opt
gggagaaagcuuaccaugcgcggccucuccucccgcaagcgccgcucccacgacguccucaccguccaguuccucauccucggcaugcuccucaugaccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8088 - RNA, 2365 nt, Artificial Sequence; identical to SEQ ID NO: 7985
  KU321639.1 prME-long mRNA Design 3 opt

SEQ ID NO: 8089 - RNA, 2365 nt, Artificial Sequence; identical to SEQ ID NO: 7986
  KU312312.1 prME-long mRNA Design 3 opt

SEQ ID NO: 8090 - RNA, 2353 nt, Artificial Sequence; identical to SEQ ID NO: 7987
  AY632535.2 prME-long mRNA Design 3 opt

SEQ ID NO: 8091 - RNA, 2365 nt, Artificial Sequence; identical to SEQ ID NO: 7988
  KU527068.1 prME-long mRNA Design 3 opt

SEQ ID NO: 8092 - RNA, 2365 nt, Artificial Sequence
  KU720415.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8093 - RNA, 2347 nt, Artificial Sequence
  DQ859059.1 prME-long mRNA Design 3 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8094 - RNA, 2365 nt, Artificial Sequence
  KX377335.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8095 - RNA, 2365 nt, Artificial Sequence
  LC002520.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8096 - RNA, 2353 nt, Artificial Sequence
  KU963573.2 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8097 - RNA, 2365 nt, Artificial Sequence
  KX694534.2 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8098 - RNA, 2365 nt, Artificial Sequence
  KX447520.1 prME-long mRNA Design 3 opt
gggagaaagcuuaccaugcgcaucaucaacgcccgcaaggagaagaagcgccgcggcgccgacgccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8099 - RNA, 2365 nt, Artificial Sequence
  KX369547.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8100 - RNA, 2365 nt, Artificial Sequence
  KX447515.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8101 - RNA, 2365 nt, Artificial Sequence
  KU501217.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8102 - RNA, 2365 nt, Artificial Sequence
  KU312314.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8103 - RNA, 2365 nt, Artificial Sequence
  KX446950.2 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8104 - RNA, 2365 nt, Artificial Sequence
  KY003157.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8105 - RNA, 2365 nt, Artificial Sequence
  KX811222.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8106 - RNA, 2365 nt, Artificial Sequence
  KX447516.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8107 - RNA, 2365 nt, Artificial Sequence
  KX520666.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8108 - RNA, 2365 nt, Artificial Sequence
  KU729218.1 prME-long mRNA Design 3 opt
gggagaaagcuuaccaugcgcaucaucaacgcccgcaaggagaagaagcgccgcuccgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8109 - RNA, 2365 nt, Artificial Sequence
  KU761561.1 prME-long mRNA Design 3 opt
gggagaaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8110 - RNA, 2365 nt, Artificial Sequence
  KY317938.1 prME-long mRNA Design 3 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8111 - RNA, 2365 nt, Artificial Sequence
  KY075939.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8112 - RNA, 2365 nt, Artificial Sequence
  KX806557.2 prME-long mRNA Design 3 opt
gggagaaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8113 - RNA, 2365 nt, Artificial Sequence
  KU870645.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8114 - RNA, 2365 nt, Artificial Sequence
  KU729217.2 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8115 - RNA, 2365 nt, Artificial Sequence
  KU497555.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8116 - RNA, 2365 nt, Artificial Sequence
  KX087101.3 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8117 - RNA, 2365 nt, Artificial Sequence
  KY075932.1 prME-long mRNA Design 3 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8118 - RNA, 2365 nt, Artificial Sequence
  KY014317.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8119 - RNA, 2365 nt, Artificial Sequence
  KU758876.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8120 - RNA, 2365 nt, Artificial Sequence
  KU758874.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8121 - RNA, 2365 nt, Artificial Sequence
  KY014314.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8122 - RNA, 2365 nt, Artificial Sequence
  KU926310.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8123 - RNA, 2365 nt, Artificial Sequence
  KU761560.1 prME-long mRNA Design 3 opt
gggagaaagcuuaccaugcgcaucaucaacgccggcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8124 - RNA, 2365 nt, Artificial Sequence
  KY317939.1 prME-long mRNA Design 3 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8125 - RNA, 2365 nt, Artificial Sequence
  KY075937.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8126 - RNA, 2365 nt, Artificial Sequence
  LC191864.1 prME-long mRNA Design 3 opt
gggagaaagcuuaccaugcgcaucaucaacgcccgcaaggagaagaagcgccgcggcgccgacaccaacgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8127 - RNA, 2365 nt, Artificial Sequence
  KX447517.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8128 - RNA, 2365 nt, Artificial Sequence
  KU922923.1 prME-long mRNA Design 3 opt
gggagaaagcuuaccaugcgcaucaucaacgcccgcaaggagaagaagcgccgcggcgccgagaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8129 - RNA, 2365 nt, Artificial Sequence
  KY003156.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8130 - RNA, 2365 nt, Artificial Sequence
  KU312313.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8131 - RNA, 2365 nt, Artificial Sequence
  KY075935.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8132 - RNA, 2365 nt, Artificial Sequence
  KY014320.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8133 - RNA, 2365 nt, Artificial Sequence
  KX827309.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8134 - RNA, 2365 nt, Artificial Sequence
  KU681081.3 prME-long mRNA Design 3 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8135 - RNA, 2365 nt, Artificial Sequence
  KU744693.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcggcgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8136 - RNA, 2365 nt, Artificial Sequence
  KY328290.1 prME-long mRNA Design 3 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8137 - RNA, 2365 nt, Artificial Sequence
  KX694532.2 prME-long mRNA Design 3 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8138 - RNA, 2365 nt, Artificial Sequence
  KU955593.1 prME-long mRNA Design 3 opt
gggagaaagcuuaccaugcgcaucaucaacgcccgcaaggagaagaagcgccgcggcaccgacaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8139 - RNA, 2365 nt, Artificial Sequence
  KY272987.1 prME-long mRNA Design 3 opt
gggagaaagcuuaccaugcgcaucaucaacgcccgcaaggagaagaagcgccgcggcaccgacaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8140 - RNA, 2365 nt, Artificial Sequence
  EU545988.1 prME-long mRNA Design 3 opt
gggagaaagcuuaccaugcgcaucaucaacgcccgcaaggagaagaagcgccgcggcaccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8141 - RNA, 2365 nt, Artificial Sequence
  KU681082.3 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8142 - RNA, 2365 nt, Artificial Sequence
  KX601167.1 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8143 - RNA, 2365 nt, Artificial Sequence
  KX694533.2 prME-long mRNA Design 3 opt
gggagaaagcuuaccaugcgcaucaucaacgcccgcaaggagaagaagcgccgcggcgccgacaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8144 - RNA, 2365 nt, Artificial Sequence
  KY288905.1 prME-long mRNA Design 3 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8145 - RNA, 2365 nt, Artificial Sequence
  KF268950.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8146 - RNA, 2365 nt, Artificial Sequence
  KF383121.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8147 - RNA, 2347 nt, Artificial Sequence
  KF268949.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8148 - RNA, 2365 nt, Artificial Sequence
  KU955595.1 prME-long mRNA Design 3 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8149 - RNA, 2365 nt, Artificial Sequence
  KF383116.1 prME-long mRNA Design 3 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8150 - RNA, 2347 nt, Artificial Sequence
  KU963574.2 prME-long mRNA Design 3 opt
gggagaaagcuuaccaugcgcaucaucaacgcccgcaaggagcgcaagcgccgcggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8151 - RNA, 2347 nt, Artificial Sequence
  KX601166.1 prME-long mRNA Design 3 opt
gggagaaagcuuaccaugcgcaucaucaacgcccgcaaggagcgcaagcgccgcggcgccgacaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8152 - RNA, 2365 nt, Artificial Sequence
  KF383118.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccgacgucggcugcuccgucgacuucuccaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8153 - RNA, 2359 nt, Artificial Sequence
  KF383120.1 prME-long mRNA Design 3 opt
gggagaaagcuuaccaugcgcaucaucaacgcccgcaaggagcgcaagcgccgcggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccgacgucggcugcuccgucgacuucugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8154 - RNA, 2290 nt, Artificial Sequence; identical to SEQ ID NO: 7989
  KU321639.1 prME-short mRNA Design 3 opt

SEQ ID NO: 8155 - RNA, 2290 nt, Artificial Sequence; identical to SEQ ID NO: 7990
  KU312312.1 prME-short mRNA Design 3 opt

SEQ ID NO: 8156 - RNA, 2278 nt, Artificial Sequence; identical to SEQ ID NO: 7991
  AY632535.2 prME-short mRNA Design 3 opt

SEQ ID NO: 8157 - RNA, 2290 nt, Artificial Sequence; identical to SEQ ID NO: 7992
  KU527068.1 prME-short mRNA Design 3 opt

SEQ ID NO: 8158 - RNA, 2290 nt, Artificial Sequence
  KX421193.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8159 - RNA, 2290 nt, Artificial Sequence
  KX377335.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccgcaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8160 - RNA, 2290 nt, Artificial Sequence
  LC002520.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8161 - RNA, 2272 nt, Artificial Sequence
  DQ859059.1 prME-short mRNA Design 3 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8162 - RNA, 2278 nt, Artificial Sequence
  KU963573.2 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8163 - RNA, 2290 nt, Artificial Sequence
  KX694534.2 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggccgcggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8164 - RNA, 2290 nt, Artificial Sequence
  KX369547.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggccucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8165 - RNA, 2290 nt, Artificial Sequence
  KX447515.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8166 - RNA, 2290 nt, Artificial Sequence
  KU729218.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8167 - RNA, 2290 nt, Artificial Sequence
  KU501217.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8168 - RNA, 2290 nt, Artificial Sequence
  KU312314.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8169 - RNA, 2290 nt, Artificial Sequence
  KX446950.2 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccacccucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8170 - RNA, 2290 nt, Artificial Sequence
  KY003157.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgucgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8171 - RNA, 2290 nt, Artificial Sequence
  KX811222.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccgccugggucgucuacggcaccugccaccacaagaagggcgaggcccgccgcucccgccgcgccgucacccuccccucccacuccacccgcaagcuccagacccgcccccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8172 - RNA, 2290 nt, Artificial Sequence
  KX447516.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccuccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8173 - RNA, 2290 nt, Artificial Sequence
  KX520666.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccacccgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8174 - RNA, 2290 nt, Artificial Sequence
  KU497555.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8175 - RNA, 2290 nt, Artificial Sequence
  KY075939.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8176 - RNA, 2290 nt, Artificial Sequence
  KY075932.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcaucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8177 - RNA, 2290 nt, Artificial Sequence
  KU870645.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauccuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8178 - RNA, 2290 nt, Artificial Sequence
  KU729217.2 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8179 - RNA, 2290 nt, Artificial Sequence
  KX087101.3 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8180 - RNA, 2290 nt, Artificial Sequence
  KY014317.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8181 - RNA, 2290 nt, Artificial Sequence
  KU758876.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucuccuucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8182 - RNA, 2290 nt, Artificial Sequence
  KU758874.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8183 - RNA, 2290 nt, Artificial Sequence
  KY317939.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaaggacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8184 - RNA, 2290 nt, Artificial Sequence
  KY014314.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8185 - RNA, 2290 nt, Artificial Sequence
  KX447517.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagacccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8186 - RNA, 2290 nt, Artificial Sequence
  KU926310.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8187 - RNA, 2290 nt, Artificial Sequence
  KU922923.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8188 - RNA, 2290 nt, Artificial Sequence
  KY075937.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8189 - RNA, 2290 nt, Artificial Sequence
  KY003156.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8190 - RNA, 2290 nt, Artificial Sequence
  KU312313.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccauccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8191 - RNA, 2290 nt, Artificial Sequence
  KY075935.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccagcgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8192 - RNA, 2290 nt, Artificial Sequence
  KY014320.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccaggcccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8193 - RNA, 2290 nt, Artificial Sequence
  KY328290.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8194 - RNA, 2290 nt, Artificial Sequence
  KU681081.3 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcguccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8195 - RNA, 2290 nt, Artificial Sequence
  KX827309.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8196 - RNA, 2290 nt, Artificial Sequence
  KU955593.1 prME-short mRNA Design 3 opt
gggagaaagcuuaccaugaccuccgucggcaucgucggccuccuccucaccaccgccauggccgucgaggucacccgccgcggcaacgccuacuacauguaccucgaccgcuccgacgccggcgaggccaucuccuuccccaccaccaugggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8197 - RNA, 2290 nt, Artificial Sequence
  KY272987.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8198 - RNA, 2290 nt, Artificial Sequence
  KY007221.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucgucugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8199 - RNA, 2290 nt, Artificial Sequence
  EU545988.1 prME-short mRNA Design 3 opt
gggagaaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8200 - RNA, 2290 nt, Artificial Sequence
  KU681082.3 prME-short mRNA Design 3 opt
gggagaaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgucaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8201 - RNA, 2290 nt, Artificial Sequence
  KX601167.1 prME-short mRNA Design 3 opt
gggagaaagcuuaccaugaccuccgucggcaucgucggccuccuccucaccaccgccauggccgucgaggucacccgccgcggcuccgccuacuacauguaccucgaccgcuccgacgccggcgaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8202 - RNA, 2290 nt, Artificial Sequence
  KX694533.2 prME-short mRNA Design 3 opt
gggagaaagcuuaccaugaccuccgucggcaucgucggccuccuccucaccaccgccauggccgucgaggucacccgccgcggcuccgccuacuacauguaccucgaccgcuccgacgccggcaaggccaucuccuuccccaccacccucggcgucaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8203 - RNA, 2290 nt, Artificial Sequence
  KY288905.1 prME-short mRNA Design 3 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucacccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8204 - RNA, 2290 nt, Artificial Sequence
  KF268950.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8205 - RNA, 2290 nt, Artificial Sequence
  KF383121.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8206 - RNA, 2272 nt, Artificial Sequence
  KF268949.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccaaccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgccgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8207 - RNA, 2290 nt, Artificial Sequence
  KU955595.1 prME-short mRNA Design 3 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8208 - RNA, 2290 nt, Artificial Sequence
  KF383116.1 prME-short mRNA Design 3 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccagcacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8209 - RNA, 2272 nt, Artificial Sequence
  KX601166.1 prME-short mRNA Design 3 opt
gggagaaagcuuaccaugaccuccaucggcaucgucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8210 - RNA, 2290 nt, Artificial Sequence
  KF383118.1 prME-short mRNA Design 3 opt
gggagaaagcuuaccaugaccuccaucggcaucaucggccuccuccucaccaccgccauggccgccgagaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgagacccgccgcucccgccgcuccgucucccuccgcuaccacuacacccgcaagcuccagacccgcucccagaccuggcucgagucccgcgaguacaagaagcaccucaucauggucgagaacuggaucuuccgcaaccccggcuucgccaucgucuccgucgccaucaccuggcucaugggcucccucaccucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8211 - RNA, 2287 nt, Artificial Sequence
  KX447520.1 prME-short mRNA Design 3 opt
gggagaaagcuuaccauguccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8212 - RNA, 2290 nt, Artificial Sequence
  KU761561.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8213 - RNA, 2290 nt, Artificial Sequence
  KX806557.2 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggauguuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8214 - RNA, 2290 nt, Artificial Sequence
  LC191864.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaugaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8215 - RNA, 2290 nt, Artificial Sequence
  KU744693.1 prME-short mRNA Design 3 opt
gggagaaagcuuaccaugaccuccgucggcaucgucggccuccuccucaccaccgccauggccgccgaggucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucaucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccggcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8216 - RNA, 2281 nt, Artificial Sequence
  KU963574.2 prME-short mRNA Design 3 opt
gggagaaagcuuaccaugggcgccgacgccuccaucggcaucgucucccuccuccucaccaccgucauggccgccgagaucacccgccgcggcuccgccuacuacauguaccucgaccgcuccgacgccggcaaggccaucuccuucgucaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8217 - RNA, 2299 nt, Artificial Sequence
  KF383120.1 prME-short mRNA Design 3 opt
gggagaaagcuuaccaugggcgccgacaccuccaucggcaucaucggccuccuccucaccaccgccauggccgccgagaucacccgccgcggcuccgccuacuacauguaccucgaccgcuccgacgccggcaaggccaucuccuucgccaccaccaugggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccccucccgccgcgccgucacccuccccucccacuccacccgcaagcuccagacccgcucccagaccuggcucgagucccgcgaguacaccaagcaccucaucaaggucgagaacuggauccuccgcaaccccggcuucaccgucgccgcccucgccauggccuggcuccucggcaacuccaccucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcguccaccaggucuucggcgccgccuucaagucccucuucggcggcauguccugguucucccagauccucaucggcacccuccucgucuggcucggccucaacaccaagaacggcuccaucucccucgccugccucgcccucggcggcgccaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8218 - RNA, 1582 nt, Artificial Sequence; identical to SEQ ID NO: 7993
  KU321639.1 solE mRNA Design 3 opt

SEQ ID NO: 8219 - RNA, 1582 nt, Artificial Sequence; identical to SEQ ID NO: 7994
  KU312312.1 solE mRNA Design 3 opt

SEQ ID NO: 8220 - RNA, 1570 nt, Artificial Sequence; identical to SEQ ID NO: 7995
  AY632535.2 solE mRNA Design 3 opt

SEQ ID NO: 8221 - RNA, 1582 nt, Artificial Sequence; identical to SEQ ID NO: 7994
  KU527068.1 solE mRNA Design 3 opt

SEQ ID NO: 8222 - RNA, 1582 nt, Artificial Sequence
  KX421193.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8223 - RNA, 1582 nt, Artificial Sequence
  LC002520.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaccgucaacgacaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8224 - RNA, 1564 nt, Artificial Sequence
  DQ859059.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8225 - RNA, 1570 nt, Artificial Sequence
  KU963573.2 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8226 - RNA, 1582 nt, Artificial Sequence
  KY075939.1 solE mRNA Design 3 opt
gggagaaagcuuaccaugucccagaaggucaucuaccucgucaugauccuccucaucgcccccgccuacucccuccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8227 - RNA, 1582 nt, Artificial Sequence
  KX447516.1 solE mRNA Design 3 opt
gggagaaagcuuaccauguccaagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8228 - RNA, 1582 nt, Artificial Sequence
  KX447515.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacugguaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8229 - RNA, 1582 nt, Artificial Sequence
  KU758874.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggcaagcucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8230 - RNA, 1582 nt, Artificial Sequence
  KU729218.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacacccagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8231 - RNA, 1582 nt, Artificial Sequence
  KU501217.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagauccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8232 - RNA, 1582 nt, Artificial Sequence
  KU761561.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgcccgccgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8233 - RNA, 1582 nt, Artificial Sequence
  KY075937.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggucuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8234 - RNA, 1582 nt, Artificial Sequence
  KY014317.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaucgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8235 - RNA, 1582 nt, Artificial Sequence
  KU870645.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcaucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8236 - RNA, 1582 nt, Artificial Sequence
  KU922923.1 solE mRNA Design 3 opt
gggagaaagcuuaccaugucccagaaggucaucuaccucgucaugauccuccucaucgcccucgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8237 - RNA, 1582 nt, Artificial Sequence
  KU497555.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcacccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8238 - RNA, 1582 nt, Artificial Sequence
  KU312314.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccucgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8239 - RNA, 1582 nt, Artificial Sequence
  KY014314.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggaggcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8240 - RNA, 1582 nt, Artificial Sequence
  KX447517.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccgcccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8241 - RNA, 1582 nt, Artificial Sequence
  KU729217.2 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucuccaccaccgucuccaacauggccgagguccgcuccuacugcuacgaggccaccaucuccgacaucgccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgccgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8242 - RNA, 1582 nt, Artificial Sequence
  KY328290.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucuccaagauccccgccgagacccuccacggcaccgucaccgaggagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8243 - RNA, 1582 nt, Artificial Sequence
  KX087101.3 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagcuccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8244 - RNA, 1582 nt, Artificial Sequence
  KY003156.1 solE mRNA Design 3 opt
gggagaaagcuuaccaugucccagaaggucaucuaccucgucaugauccuccucaucgcccccgccuacuccauccgcugcaucggcaucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcauccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8245 - RNA, 1582 nt, Artificial Sequence
  KU758876.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgucaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8246 - RNA, 1582 nt, Artificial Sequence
  KU926310.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcgccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8247 - RNA, 1582 nt, Artificial Sequence
  KU681081.3 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacaccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgagggcaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8248 - RNA, 1582 nt, Artificial Sequence
  KU744693.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgccauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugcucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucgcccacaaggagugguuccacgacaucccccuccccuggcacgccggcgccgccaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagaccgucgacggcaccgucaccgucgagggccaguacggcggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8249 - RNA, 1582 nt, Artificial Sequence
  EU545988.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccgccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8250 - RNA, 1582 nt, Artificial Sequence
  KY007221.1 solE mRNA Design 3 opt
gggagaaagcuuaccaugucccagaaggucaucuaccucgucaugauccuccucaucgcccccgccuacuccauccgcugcaucggcgucaacaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8251 - RNA, 1582 nt, Artificial Sequence
  KY003152.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcgccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8252 - RNA, 1582 nt, Artificial Sequence
  KX694533.2 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8253 - RNA, 1582 nt, Artificial Sequence
  KX601167.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacugguaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8254 - RNA, 1582 nt, Artificial Sequence
  KY288905.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8255 - RNA, 1582 nt, Artificial Sequence
  KF268950.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8256 - RNA, 1582 nt, Artificial Sequence
  KF383116.1 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgucugcaccgccgccaagguccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8257 - RNA, 1564 nt, Artificial Sequence
  KU963574.2 solE mRNA Design 3 opt
gggagaaagcuuaccaugucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacuccggcgccgacaccgagaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggccgcgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaucaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8258 - RNA, 1582 nt, Artificial Sequence
  KF383118.1 solE mRNA Design 3 opt
gggagaaagcuuaccaugucccagaaggucaucuaccucgucaugaucguccucaucguccccgccuacuccaucuccugcaucggcgucuccaaccgcgaccucgucgagggcauguccggcggcaccugggucgacgucguccucgagcacggcggcugcgucaccgagauggcccaggacaagcccaccgucgacaucgagcucgucaccaugaccgucuccaacauggccgagguccgcuccuacugcuacgaggccucccucuccgacauggccuccgccucccgcugccccacccagggcgagcccucccucgacaagcaguccgacacccaguccgucugcaagcgcacccucggcgaccgcggcuggggcaacggcugcggcaucuucggcaagggcucccucgucaccugcuccaaguucaccugcugcaagaagaugcccggcaaguccauccagcccgagaaccucgaguaccgcaucaugcuccccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguccgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8259 - RNA, 1582 nt, Artificial Sequence
  KX520666.1 solE mRNA Design 3 opt
gggagaaagcuuaccaugcgccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8260 - RNA, 1582 nt, Artificial Sequence
  KF383120.1 solE mRNA Design 3 opt
gggagaaagcuuaccaugucccagcgcgucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucgucaacgacaucggccacgagaccgacgagaaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgcaucaagauggacaagcuccgccucaagggcgucuccuacucccucugcaccgccgccuucaccuucuccaagguccccgccgagacccuccacggcaccgucaccgucgagguccaguacgccggccgcgacggccccugcaagguccccgcccagauggccgucgacaugcagacccucacccccgucggccgccucaucaccgccaaccccaucaucaccgaguccaccgagaacucccgcaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8261 - RNA, 2365 nt, Artificial Sequence
  ZIKV (strain ZikaSPH2015) Polyprotein(93-804) mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacauaguguuagagcauggcgggugugucaccgugauggcacaggauaagccaacaguggacauugagcuggucaccacgacuguuucaaauauggcugaagugcguaguuacugcuaugaggccagcaucucugauauggcguccgacucacgcugucccacacaaggagaagccuaccuugacaaacagagcgauacccaguauguaugcaagagaacuuugguggacaggggcugggguaacggguguggacuguucggcaaaggcagucuagucacaugcgcaaaguuugcuugcucuaagaaaaugaccgggaaguccauucagccugagaaucucgaauaccggaucaugcugagcgugcacggaucgcaacacucugguaugaucguuaacgauacgggccaugagaccgacgagaaucgagccaaaguggaaauuacaccaaacucaccccgcgcugaggccacucuugggggauucggcucccuggguuuggauugugaaccuagaaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagaggcagaccguaguugugcugggcagccaggagggggccguccauaccgcuuuggccggagcacuagaagccgagauggauggugcuaagggccggcuguccucugggcaccucaaaugccgccugaagauggacaaacuuagacugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagguuaauuacagccaacccagugaucacggaaaguaccgaaaauuccaagaugaugcuggagcuagaucccccguucggagacagcuacauaguuauuggcgugggggagaaaaagaucacucaccacuggcaucguucuggaucaacaaucgguaaggcuuuugaggccaccguccggggcgcaaaacgaauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8262 - RNA, 2365 nt, Artificial Sequence
  ZIKV (isolate Z1106033) Polyprotein(93-804) mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacacuugugacgccaccaugucauacgaaugcccuaugcuggaugagggcguggaaccagacgauguagacuguuggugcaauacaaccaguacuuggguggucuaugguacaugucaucacaagaaaggggaggcuaggcggagccgcagagcagugacccuaccgucccauucuacgaggaagcuccaaacucggucgcagaccuggcuggagucacgcgaauacacaaagcaccuuauucgaguugagaacuggaucuuuagaaaucccggauucgcccuggcugccgcggcaauagccugguugcucggcagcaguacuucccagaaagugaucuaucuggucaugauucugcucaucgcuccugccuacucuauuaggugcaucggcgugagcaaccgggauuuuguagaagggauguccggagguaccuggguugacguggucuuagagcauggcgggugugugacagugauggcacaggauaagccaaccgucgacauagagcugguuacgacuacagugucaaauauggcugaaguacguaguuacugcuaugaggccagcauuucugauauggcguccgacucacgcugucccacccaaggagaagccuaccuugacaaacagagcgauacucaguaugugugcaagagaacauuggucgacaggggcugggguaacggguguggacuguucggcaaaggcagucuagugaccugcgcaaaguuugcuugcucuaagaaaaugacggggaaguccauccagccugagaaucucgaauaccggauuaugcugagcguucacggaucgcaacacucugguaugaucgugaacgauaccggccaugagacagacgagaaucgagccaaagucgaaaucacuccaaacucaccccgcgcugaggccacccuugggggauucggcucccuggguuuggauugugaaccuagaacagggcucgacuuuagugaucuguauuacuuaacuaugaauaacaagcacuggcuggugcauaaagagugguuccacgacauuccacucccguggcacgcaggcgccgauaccggaacaccccauuggaauaacaaggaagcucuuguagaguuuaaagacgcgcacgcaaagaggcagaccguugugguccugggcagccaggagggggccgugcauacugcuuuggccggagcacuagaagccgagauggauggugcuaagggccggcuguccucugggcaccucaaaugccgccugaagauggacaaacuuagacugaagggagucagcuauucauuguguacggccgcauucacauuuaccaaaauaccugcggaaacucuccauggcaccgugacaguugaggugcaguacgcugguaccgacgggccaugcaagguacccgcccaaauggcagucgauaugcagacucugacaccugugggcagguuaaucacggccaacccaguuauuaccgaaaguacugaaaauuccaagaugaugcuggagcuagaucccccguucggagacagcuacaucgugauaggcgucggggagaaaaagauuacacaccacuggcaucguucuggaucaaccaucgguaaggcuuuugaggccacagugcggggcgcaaaacgaauggcuguacucggggacacugccugggauuucggaagugugggcggugcgcugaacagccuugggaaaggcauccaccagauuuucggagccgcuuuuaaguccuuguucggcgggaugucuugguuuucgcaaauccugauuggaacccuccugauguggcuuggccugaaugcaaagaacgguagcauauccuugaugugucucgccuuagggggaguucugaucuuccugucaacggcugucagugccgacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8263 - RNA, 2353 nt, Artificial Sequence
  ZIKV (strain MR 766) Polyprotein(93-800) mRNA Design 3 opt
gggagaaagcuuaccaugagaaucauuaacgccaggaaggagcggaaacgccgaggcgcugacaccagcauagggaucauuggacugcuccuuacaacugcaauggccgcggaaaucacgcguagagguuccgcuuacuauauguaccuggauaggucugacgccggcaaggcaauuucauucgccaccacauugggggugaauaaaugccacguccagaucauggauuuaggacauaugugugacgcuacuaugaguuaugagugccccaugcuggaugaaggcguugagccugacgauguggacuguuggugcaacaccacaagcaccuggguaguguacgguacuugucaccauaagaaaggggaagcacggcgcuccagaagggccgucacacuaccaucucacucgacccggaagcuccaaacgcgcucacagacuuggcuggagagccgagaguauaccaagcaucuuauaaaaguggaaaauuggaucuuuagaaacccgggauucgcucugguugccguggcgauugcaugguugcucggcaguuccacaucucagaaggucaucuaccuggugaugauucugcucaucgcccccgcuuauagcauaaggugcauuggcguauccaaucgggauuuuguugaggggaugucaggagguacuuggguggacgucguguuagaacacggcgggugugugaccgucauggcccaggauaaaccuacaguugacaucgagcuggugaccacgacuguaaguaacauggcagaggugcguagcuacugcuacgaggcuucuauuuccgauauggccucagacagccgcuguccaacacaaggagaagcguaucuugacaagcagagugauacccaguacgucugcaaaagaacuuugguggacaggggcugggguaauggguguggacuguucggcaagggcucucuaguuacaugcgccaaguuuaccugcuccaaaaagaugacggggaaaagcauccagcccgaaaaccucgaguaucggaucaugcugucggugcacggaucucaacauuccgguaugauuggcuacgaaaccgaugaggaccgagcaaaggucgaggugacaccuaauucaccacgcgcugaagccacucuugggggauucggcagucuggguuuggauugugagcccagaaccgggcucgacuuuagcgaucuguauuacuuaacaaugaacaauaaacacuggcugguacauaaggaaugguuccacgacauaccucucccauggcacgcuggcgccgauacuggaaccccgcauuggaacaauaaagaggcacuuguugaauuuaaggacgcccacgcuaagaggcagacaguggucgugcugggcucccaggagggggcgguccauaccgcauuggccggagcucuagaggccgaaauggauggugcaaaaggccggcuguucucugggcaccucaagugccgccugaaaauggacaaacuuagacugaagggagugagcuauucauuguguacugccgcuuuuacguucacaaagguucccgccgagacccuccauggcacugugaccguagaaguccaguacgcagguacagacgggccuugcaagaucccagugcaaauggcgguugauaugcagacccugacucccgugggcagguuaauuacagcuaacccugucaucacggagaguaccgaaaauuccaaaaugaugcuggagcuagacccacccuuuggagauagcuacauagugauuggcguaggggacaagaaaaucacucaccacuggcaucguucuggaucaacaaucgguaaggccuucgaggcaaccgugcggggcgccaaacgaauggcuguucucggggauacagccugggacuucggaagugucggcgguguguuuaacagccuggggaagggcauucaccagaucuucggagcagcuuuuaagucccuuuucggcgggaugucuugguuuucgcaaauuuugauaggaacucugcucguguggcugggccuuaacaccaaaaaugguagcaucucccugacguguuuggcccucgggggagucaugauuuuccugucaaccgcgguuagugccgaugugggcugcucuguggacuuuagcaagugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8264 - RNA, 2365 nt, Artificial Sequence
  ZIKV (strain NatalRGN) Polyprotein(93-804) mRNA Design 3 opt
gggagaaagcuuaccaugagaaucauuaacgccaggaaggagaaaaagcggcgcggcgcugacaccagcguggggauagucggacugcuccuuacaacugcaauggccgcggaaguuacgcgacgugguuccgcuuacuauauguaccuggauagaaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuaggcggagccgcagagcagugacacuaccgucccauucuaccaggaagcuccaaacgcggucgcagacuuggcuggagucacgcgaauacaccaagcaccuuauucgaguugagaacuggaucuuuagaaaucccggauucgcccuggcugccgcggcaauagccugguugcucggcagcaguacaucccagaaagugaucuaucuggucaugauucugcucaucgcuccugccuacucuauuaggugcaucggcgugagcaaccgggauuuuguagaagggauguccggagguacuuggguugacguggucuuagagcauggcgggugugugaccgugauggcacaggauaagccaacagucgacauagagcugguuaccacgacugugucaaauauggcugaaguacguaguuacugcuaugaggccagcauuucugauauggcguccgacucacgcugucccacacaaggagaagccuaccuugacaaacagagcgauacccaguaugugugcaagagaacuuuggucgacaggggcugggguaacggguguggacuguucggcaaaggcagucuagugacaugcgcaaaguuugcuugcucuaagaaaaugaccgggaaguccauccagccugagaaucucgaauaccggauuaugcugagcguucacggaucgcaacacucugguaugaucgugaacgauacgggccaugagaccgacgagaaucgagccaaagucgaaaucacaccaaacucaccccgcgcugaggccacucuugggggauucggcucccuggguuuggauugugaaccuagaaccgggcucgacuuuagugaucuguauuacuuaacaaugaauaacaagcacuggcuggugcauaaagagugguuccacgacauuccacucccguggcacgcaggcgccgauacuggaacaccccauuggaauaacaaggaagcucuuguagaguuuaaagacgcgcacgcaaagaggcagaccguugugguccugggcagccaggagggggccgugcauaccgcuuuggccggagcacuagaagccgagauggauggugcuaagggccggcuguccucugggcaccucaaaugccgccugaagauggacaaacuuagacugaagggagucagcuauucauuguguacugccgcauucacguuuacaaaaauaccugcggaaacccuccauggcacugugaccguugaggugcaguacgcugguacagacgggccaugcaagguacccgcccaaauggcagucgauaugcagacccugacuccugugggcagguuaaucacagccaacccaguuauuacggaaaguaccgaaaauuccaagaugaugcuggagcuagaucccccguucggagacagcuacaucgugauaggcgucggggagaaaaagauuacucaccacuggcaucguucuggaucaacaaucgguaaggcuuuugaggccaccgugcggggcgcaaaacgaauggcuguacucggggacacagccugggauuucggaagugugggcggugcgcugaacagccuugggaaaggcauccaccagauuuucggagccgcuuuuaaguccuuguucggcgggaugucuugguuuucgcaaauccugauuggaacucuccugauguggcuuggccugaauaccaagaacgguagcauauccuugaugugucucgcauuagggggaguucugaucuuccugucaacggccgucagugcugacgugggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8265 - RNA, 2290 nt, Artificial Sequence
  ZIKV (strain ZikaSPH2015) Polyprotein(108-794) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaauagccuugguaaggggauccaccagaucuucggcgccgcguuuaaauccuuguucggaggcaugucuugguuuucgcaaauucugaucgggacucuccugauguggcuuggacugaacaccaagaauggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8266 - RNA, 2290 nt, Artificial Sequence
  ZIKV (isolate Z1106033) Polyprotein(108-794) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaauagccuugguaaggggauucaccagaucuucggcgccgcguuuaaauccuuguucggaggcaugucuugguuuucgcaaauccugauugggacccuccugauguggcuuggacugaacgccaagaauggcagcaucuccuugaugugucucgcucugggugggguuuuaauuuuccugucaacggcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8267 - RNA, 2278 nt, Artificial Sequence
  ZIKV (strain MR 766) Polyprotein(108-790) mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacaauuggaaaggcguucgaggcuaccgugcggggugccaaacgcauggcaguucucggcgacacagccugggauuucgggagugucggaggcguguuuaauagccuggguaaggggauccaccagaucuucggcgcugccuuuaaaucccuuuucggaggcaugucuugguuuucgcaaauuuugaucgggacucugcucguguggcugggacuuaacaccaagaacggcagcauuucccugacguguuuggcacucgguggggucaugauauuccugucaaccgcuguuagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8268 - RNA, 2290 nt, Artificial Sequence
  ZIKV (strain NatalRGN) Polyprotein(108-794) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaauagccuugguaaggggauucaccagaucuucggcgccgcguuuaaauccuuguucggaggcaugucuugguuuucgcaaauccugauugggacucuccugauguggcuuggacugaacaccaagaauggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8269 - RNA, 1582 nt, Artificial Sequence
  ZIKV (strain ZikaSPH2015) Polyprotein(273-723) mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagauaucgugcuggaacacggcgggugugucacagugauggcacaagacaaaccuacuguugauauugaguuggugacgaccacagucaguaauauggccgaagugcggagcuacugcuaugaggcguccaucucugacauggcuucggauucacgcuguccaacucagggagaagccuacuuagacaagcagagcgauacccaguauguaugcaaacgaacacugguugaccguggcugggguaacggguguggacuauuuggcaagggcagucucgugaccugcgcaaaauucgccuguuccaagaagaugacugggaaaucuauacaaccggagaaucuggaguacagaaucaugcuuagcguccauggaucccagcacucagguaugauugugaacgauacaggccaugaaaccgacgagaauagggcuaagguggaaaucacgcccaacaguccucgggcagaggccacucugggaggguuuggcagcuugggucucgauugcgagccacgcaccgggcuggacuucucugaucuguauuaccucacaaugaauaacaaacacugguuaguccauaaggaaugguuucacgacauuccccugccuuggcacgcuggagccgacacuggcaccccacauuggaauaacaaagaggcgcuuguugaguucaaggaugcacacgccaagagacagacagugguaguguugggcucccaggaaggggcuguccauaccgcccuggcaggagcucuagaagccgagauggacggugcgaaaggcaggcucucaagcgggcaccugaagugucggcuuaaaauggauaagcugcgcuugaaaggagugaguuacucucucugcacggccgcauuuacuuucacaaagauccccgcugagacccugcacggcacuguuacaguggaaguccaauaugccgguaccgacgggccuuguaaagugccagcucagauggccguagauaugcagacguuaaccccgguuggccgacugauaacagcaaaucccgugauuacugaguccaccgaaaacagcaagaugaugcucgagcuugacccuccauuuggagauucguacaucgucauuggcgugggggaaaagaaaaucacacaucacuggcauagaucuggauccacuaucgguaaggccuucgaggcuaccgucaggggcgcgaaacggauggcagugcugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8270 - RNA, 1582 nt, Artificial Sequence
  ZIKV (isolate Z1106033) Polyprotein(273-723) mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucgccuguuccaagaagaugacugggaaaucuauccaaccggagaaucuggaguacagaauaaugcuuagcguccauggaucccagcacucagguaugaucgugaacgauacaggccaugaaaccgacgagaauagggcuaaggucgaaauuacgcccaacaguccucgggcagaggccacucugggaggguuuggcagcuugggucucgauugcgagccacgcaccgggcuggacuucucugaucuguauuaccucacaaugaauaacaaacacugguuaguucauaaggaaugguuucacgacaucccccugccuuggcacgcuggagccgacacuggcaccccacauuggaauaacaaagaggcgcuuguggaguucaaggaugcacacgccaagagacagacaguaguggucuugggcucccaggaaggggcugugcauaccgcccuggcaggagcucuagaagccgagauggacggugcgaaaggcaggcucucaagcgggcaccugaagugucggcuuaaaauggauaagcugcgcuugaaaggaguuaguuacucucucugcacggccgcauuuacuuucacaaagauucccgcugagacccugcacggcacugugacagucgaagugcaauaugccgguaccgacgggccuuguaaaguaccagcucagauggccguugauaugcagacguuaaccccggugggccgacugaucacagcaaaucccgucauaacugaguccaccgaaaacagcaagaugaugcucgagcuugacccuccauuuggagauucguacauugugaucggcgucggggaaaagaaaauuacacaucacuggcauagaucuggauccacuaucgguaaggccuucgaggcuaccgugaggggcgcgaaacggauggcaguucugggggacacagccugggauuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8271 - RNA, 1570 nt, Artificial Sequence
  ZIKV (strain MR 766) Polyprotein(273-719) mRNA Design 3 opt
gggagaaagcuuaccaugagccagaaggugaucuaccuggucaugauucuccuuauagcccccgcuuauuccaucagaugcauuggcguuucuaacagggacuucguggaggggaugucaggagguaccuggguagaugugguccuggaacacggcgggugugugacaguuauggcacaagacaaaccuacuguggauaucgaguuggucacgaccacagugaguaauauggccgaaguacggagcuacugcuaugaggcguccauuucugacauggcuucggauucacgcuguccaacucagggagaagccuacuuagacaagcagagcgauacccaguauguuugcaaacgaacacugguggaccguggcugggguaacggguguggacuauuuggcaagggcagucucgugaccugcgcaaaauucacuuguuccaagaagaugacagggaaaucuauccaaccggagaaucuggaguacagaauaaugcuuagcguccauggaucccagcacucagguaugaucggcuaugaaaccgaugaggacagggccaagguggaagucacgcccaacaguccucgggcugaggcaacucugggaggguuuggcagcuugggucucgauugcgagccacgcaccgggcuggacuucucugaucuguacuaccucacaaugaauaacaaacauugguuaguucacaaggaaugguuucaugacauuccccugccuuggcacgccggagcugacacuggcaccccacacuggaauaacaaagaggcccuuguggaguucaaggaugcgcaugcaaagagacagacaguaguggucuugggcucccaggaaggggccgugcacaccgcucuggccggagcacuagaagcugagauggacggugccaaaggcaggcucuuuucagggcaucugaagugucggcuuaaaauggauaagcugcgcuugaaaggaguuagcuauagucucugcacggcggccuucacuuuuacaaaggugcccgcagagacccugcacggcacugucacaguggaaguacaauacgcugguaccgacgggccuuguaaaaucccaguucagauggccguggauaugcagacguuaaccccggucggccgacugauuacagcuaaucccgugaucacugagucuaccgaaaacuccaagaugaugcucgagcuugacccuccauucggagauagcuauauagucauuggcgugggggacaagaaaaucacacaccauuggcacagaucgggaucuacuauugguaaggccuuugaagcaaccguuaggggcgccaaacggauggcugugcugggggauacagcgugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8272 - RNA, 1582 nt, Artificial Sequence; identical to SEQ ID NO: 8270
  ZIKV (strain NatalRGN) Polyprotein(273-723) mRNA Design 3 opt

SEQ ID NO: 8273 - RNA, 2290 nt, Artificial Sequence
  ZIKV (strain ZikaSPH2015) Polyprotein(108-794)(F398S) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcugaguggaaagggcucucuagucacaugcgcgaaauucgccugcuccaagaaaaugaccggcaagagcauucagccugaaaaccucgaguaccguaucaugcugucggugcacgggucucaacacuccggaaugauuguuaaugacacgggucaugaaaccgaugagaaccgcgcaaagguggagaucacaccaaauucacccagagcugaagccacucuuggcggguuuggaagucugggcuuggacugugagccuaggaccggucucgauuucagcgaccuguauuacuuaacaaugaacaauaaacacuggcugguccauaaggaaugguuucacgauaucccacucccguggcacgcuggggccgacacuggcaccccucauuggaacaauaaagaggcacuuguggaguucaaggaugcccacgcuaaacggcagacaguaguugugcugggaucccaggaaggcgcgguccauaccgcauuggccggggcucuagaggccgaaauggacggagcaaagggucgacugucuagcggccaccucaaaugccgccugaagauggauaagcugagacugaaaggggugucauauaguuuguguacugccgcuuuuacguucacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggaguccaccgaaaacagcaagaugaugcuggagcuagaucccccguuuggcgacucuuacauuguuaucggagugggcgagaaaaagauaacucaccacuggcaucggucagggaguacaauuggaaaggcauucgaagccaccguccgcggugcuaaaagaauggccgugcucggcgauacagcaugggacuuugggagcguaggaggcgcucuuaauucccuugguaaggggauccaccagaucuucggcgccgcguucaaaucuuuguuuggaggcaugucgugguucagccaaauucugaucgggacucuccugauguggcuuggacugaacaccaagaauggcuccauuucauugaugugucucgcccugggugggguguuaauauuucugaguacggcuguuucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8274 - RNA, 2290 nt, Artificial Sequence
  ZIKV (isolate Z1106033) Polyprotein(108-794)(F398S) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcugaguggaaagggcucucuagugaccugcgcgaaauucgccugcuccaagaaaaugacgggcaagagcauacagccugaaaaccucgaguaccguauuaugcugucgguucacgggucucaacacuccggaaugaucgugaaugacaccggucaugaaacagaugagaaccgcgcaaaggucgagauuacuccaaauucacccagagcugaagccacccuuggcggguuuggaagucugggcuuggacugugagccuaggacaggucucgauuucagcgaccuguauuacuuaacuaugaacaauaaacacuggcuggugcauaaggaaugguuucacgauaucccacucccguggcacgcuggggccgacaccggcacaccccauuggaacaauaaagaggcacuuguagaguucaaggaugcccacgcuaaacggcagaccguugugguccugggaucccaggaaggcgcggugcauacugcauuggccggggcucuagaggccgaaauggacggagcaaagggucgacugucuagcggccaccucaaaugccgccugaagauggauaagcugagacugaaaggggucucauauaguuuguguacggccgcuuuuacauucaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgaguccacugaaaacagcaagaugaugcuggagcuagaucccccguuuggcgacucuuacaucgugauuggagucggcgagaaaaagaucacacaccacuggcaucggucagggaguaccauaggaaaggcauucgaagccacagugcgcggugcuaaaagaauggccguacucggcgauacugcaugggacuuugggagcgugggaggcgcucuuaauucccuugguaaggggauucaccagaucuucggcgccgcguucaaaucuuuguuuggaggcaugucgugguucagccaaauccugauugggacccuccugauguggcuuggacugaacgccaagaauggcuccaucucauugaugugucucgcucugggugggguuuuaauuuuucugaguacggcagucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8275 - RNA, 2278 nt, Artificial Sequence
  ZIKV (strain MR 766) Polyprotein(108-790)(F398S) mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcugucuggaaagggcucccuaguuacaugcgccaaauuuaccugcagcaagaagaugacgggcaaaucgauccagcccgaaaaucucgaauaucggauuaugcugucugugcacgggucccaacauucaggaaugaucgguuacgagaccgacgaagaucgugcgaaggucgaggugacaccuaacaguccacgcgccgaggcaacucuuggcggguucggaagccugggcuuggacugugaacccagaaccggucucgauuucuccgaccuguauuacuuaacaaugaauaacaaacacuggcugguacauaaggagugguuucacgauaucccucucccauggcacgcuggggccgacacuggcaccccgcauuggaauaacaaagaagcucuuguugaguucaaggaugcccacgcaaaaaggcagacaguggucgugcugggaucucaggaaggcgccguccauaccgcuuuggcgggggcacuagaggccgagauggacggagcuaagggucggcuguuuagcggccaccucaagugccgacugaaaauggauaaacuucgccugaagggggugucauauaguuuguguacugccgcauucacguuuacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaauccaccgagaacagcaagaugaugcuggaacuagauccacccuucggcgacucuuacauugugaucggaguaggcgauaagaaaauaacucaccacuggcauaggucagggaguacaauuggaaaggcguuugaggcuaccgugcggggugccaaacgcauggcaguucucggcgacacagccugggauuucgggagcgucggaggcguguucaauucccuggguaaggggauccaccagaucuuuggcgcugccuucaaaucucuuuuuggaggcaugucgugguucagccaaauuuugaucgggacucugcucguguggcugggacuuaacaccaagaacggcuccauuucacugacguguuuggcacucgguggggucaugauauuucugaguaccgcuguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8276 - RNA, 2290 nt, Artificial Sequence
  ZIKV (strain NatalRGN) Polyprotein(108-794)(F399S) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcugaguggaaagggcucucuagugacaugcgcgaaauucgccugcuccaagaaaaugaccggcaagagcauacagccugaaaaccucgaguaccguauuaugcugucgguucacgggucucaacacuccggaaugaucgugaaugacacgggucaugaaaccgaugagaaccgcgcaaaggucgagauuacaccaaauucacccagagcugaagccacucuuggcggguuuggaagucugggcuuggacugugagccuaggaccggucucgauuucagcgaccuguauuacuuaacaaugaacaauaaacacuggcuggugcauaaggaaugguuucacgauaucccacucccguggcacgcuggggccgacacuggcaccccucauuggaacaauaaagaggcacuuguagaguucaaggaugcccacgcuaaacggcagacaguugugguccugggaucccaggaaggcgcggugcauaccgcauuggccggggcucuagaggccgaaauggacggagcaaagggucgacugucuagcggccaccucaaaugccgccugaagauggauaagcugagacugaaaggggucucauauaguuuguguacugccgcuuuuacguucacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggaguccaccgaaaacagcaagaugaugcuggagcuagaucccccguuuggcgacucuuacaucgugauuggagucggcgagaaaaagaucacucaccacuggcaucggucagggaguacaauaggaaaggcauucgaagccaccgugcgcggugcuaaaagaauggccguacucggcgauacagcaugggacuuugggagcgugggaggcgcucuuaauucccuugguaaggggauucaccagaucuucggcgccgcguucaaaucuuuguuuggaggcaugucgugguucagccaaauccugauugggacucuccugauguggcuuggacugaacaccaagaauggcuccaucucauugaugugucucgcccugggugggguuuuaauuuuucugaguacggcugucucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8277 - RNA, 2290 nt, Artificial Sequence
  ZIKV (strain ZikaSPH2015) Polyprotein(108-794)(N444Q) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguucaggacacgggucaugaaaccgaugagaaucgcgcaaagguggagaucacaccaaacucccccagagcugaagccacucuuggcggguucggaucacugggcuuggacugugagccuaggaccggucucgauuuuagugaccuguauuacuuaacaaugaauaacaaacacuggcugguccauaaggaaugguuccacgauaucccacucccguggcacgcuggggccgacacuggcaccccucauuggaauaacaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaauacgcaggcacagacgguccaugcaaagugcccgcgcagauggcuguagacaugcagacccugacuccugucgggagguuaauaacagccaauccagugaucacggagaguaccgaaaacuccaagaugaugcuggagcuagaucccccguucggcgacagcuacauuguuaucggagugggcgagaaaaagauaacucaccacuggcaucggucugggucaacaauuggaaaggcauuugaagccaccguccgcggugcuaaaagaauggccgugcucggcgauacagcaugggacuucgggaguguaggaggcgcucugaacagccuugguaaggggauccaccaaaucuucggcgccgcguuuaaauccuuguucggaggcaugucuugguuuucgcagauucugaucgggacucuccugauguggcuuggacugaauaccaagaacggcagcauuuccuugaugugucucgcccugggugggguguuaauauuccugucaacggcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8278 - RNA, 2290 nt, Artificial Sequence
  ZIKV (isolate Z1106033) Polyprotein(108-794)(N444Q) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugcaggacaccggucaugaaacagaugagaaucgcgcaaaggucgagauuacuccaaacucccccagagcugaagccacccuuggcggguucggaucacugggcuuggacugugagccuaggacaggucucgauuuuagugaccuguauuacuuaacuaugaauaacaaacacuggcuggugcauaaggaaugguuccacgauaucccacucccguggcacgcuggggccgacaccggcacaccccauuggaauaacaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaauacgcaggcaccgacgguccaugcaaaguacccgcgcagauggcugucgacaugcagacucugacaccuguggggagguuaauuacggccaauccaguuauaaccgagaguacugaaaacuccaagaugaugcuggagcuagaucccccguucggcgacagcuacaucgugauuggagucggcgagaaaaagaucacacaccacuggcaucggucugggucaaccauaggaaaggcauuugaagccacagugcgcggugcuaaaagaauggccguacucggcgauacugcaugggacuucgggagugugggaggcgcucugaacagccuugguaaggggauucaccaaaucuucggcgccgcguuuaaauccuuguucggaggcaugucuugguuuucgcagauccugauugggacccuccugauguggcuuggacugaaugccaagaacggcagcaucuccuugaugugucucgcucugggugggguuuuaauuuuccugucaacggcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8279 - RNA, 2290 nt, Artificial Sequence
  ZIKV (strain NatalRGN) Polyprotein(108-794)(N444Q) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugcaggacacgggucaugaaaccgaugagaaucgcgcaaaggucgagauuacaccaaacucccccagagcugaagccacucuuggcggguucggaucacugggcuuggacugugagccuaggaccggucucgauuuuagugaccuguauuacuuaacaaugaauaacaaacacuggcuggugcauaaggaaugguuccacgauaucccacucccguggcacgcuggggccgacacuggcaccccucauuggaauaacaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaauacgcaggcacagacgguccaugcaaaguacccgcgcagauggcugucgacaugcagacccugacuccuguggggagguuaauuacagccaauccaguuauaacggagaguaccgaaaacuccaagaugaugcuggagcuagaucccccguucggcgacagcuacaucgugauuggagucggcgagaaaaagaucacucaccacuggcaucggucugggucaacaauaggaaaggcauuugaagccaccgugcgcggugcuaaaagaauggccguacucggcgauacagcaugggacuucgggagugugggaggcgcucugaacagccuugguaaggggauucaccaaaucuucggcgccgcguuuaaauccuuguucggaggcaugucuugguuuucgcagauccugauugggacucuccugauguggcuuggacugaauaccaagaacggcagcaucuccuugaugugucucgcccugggugggguuuuaauuuuccugucaacggcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8280 - RNA, 2290 nt, Artificial Sequence
  ZIKV (strain ZikaSPH2015) Polyprotein(108-694)-Cterm-JAEV1-E(400-500) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauauuguguuagaacaugguggcugugucaccgugauggcucaggacaagccaacaguggauaucgagcuggucaccacgacuguuucaaacauggccgaggugcgaaguuacugcuaugaagcaagcauaucugacauggcuuccgauucaagaugucccacacaaggggaggccuaccuugacaagcagagcgacacccaguauguaugcaaaaggacuuugguggaucggggauggggcaaugguugugggcuguucggaaagggcagucuagucacaugcgcgaaauuugccugcucuaagaaaaugaccggcaaguccauucagccugaaaaccucgaguaccguaucaugcugagcgugcacgggucgcaacacucuggaaugauuguuaaugacacgggucaugaaaccgaugagaaccgcgcaaagguggagaucacaccaaauucccccagagcugaagccacucuuggcggguucggaucacugggcuuggacugugagccuaggaccggucucgauuuuagugaccuguauuacuuaacaaugaacaauaaacacuggcugguccauaaggaaugguuccacgauaucccacucccguggcacgcuggggccgacacuggcaccccucauuggaacaauaaagaggcacuuguggaauuuaaggaugcccacgcuaaacggcagacaguaguugugcugggaagccaggagggcgcgguccauaccgcauuggccggggcucuagaggccgaaauggacggagcaaagggucgacuguccucuggccaccucaaaugccgccugaagauggauaaacuuagacugaagggggugagcuauucauuguguacugccgcuuucacguuuacaaagauuccugccgagacccuccauggaacugucaccguggaaguucaguacgcaggcacagacgguccaugcaaagugcccgcgcaaauggcuguagacaugcagacccugacuccugucgggagguuaauaacagccaacccagugaucacggagaguaccgaaaacuccaagaugaugcuggagcuagaucccccguucggcgacagcuacauuguuaucggagugggcgagaaaaagauaacucaccacuggcaucggucugggucaacacucggaaaggcauuuaguaccacacugaaaggugcccagcgccuugcugccuugggcgauacugcaugggacuucgggagcauuggaggcgucuucaauuccaucgguagagcugugcaccaaguauuugggggcgccuucaggacccuguuuggaggcaugucuuggaucacgcaggggcucaugggagcgcugcuucuguggaugggcgugaacgcccgugaucggucgauugcuuuggcauuccucgccaccggugggguucuggucuuuuuagcuacaaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8281 - RNA, 2290 nt, Artificial Sequence
  ZIKV (isolate Z1106033) Polyprotein(108-694)-Cterm-JAEV1-E(400-500) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacacuugugaugccaccaugucauacgagugcccuaugcuggacgaaggaguggagccagaugacguagauuguuggugcaacacaaccaguacuuggguggucuauggcacaugucaucacaaaaagggugaagcacgccgaagccguagagccgugacccuaccgucccauucuacgaggaaacuccaaacucggucgcagaccuggcuggagucacgcgaguacacaaagcaccuuauuagaguugaaaauuggaucuuuaggaaccccggguucgcucuggcagccgcugccauugcgugguugcucggaagcaguacuucccagaaagugaucuaucuggucaugauacugcucaucgccccugcauacucuauucggugcaucggcgugagcaaucgcgacuuuguagagggcauguccgggggaaccuggguugauguggucuuagaacaugguggcugugugacagugauggcucaggacaagccaaccgucgauauugagcugguuacgacuacagugucaaacauggccgagguacgaaguuacugcuaugaagcaagcaucucugacauggcuuccgauucaagaugucccacccaaggggaggccuaccuugacaagcagagcgacacucaguaugugugcaaaaggacauuggucgaucggggauggggcaaugguugugggcuguucggaaagggcagucuagugaccugcgcgaaauuugccugcucuaagaaaaugacgggcaaguccauacagccugaaaaccucgaguaccguauuaugcugagcguucacgggucgcaacacucuggaaugaucgugaaugacaccggucaugaaacagaugagaaccgcgcaaaggucgagauuacuccaaauucccccagagcugaagccacccuuggcggguucggaucacugggcuuggacugugagccuaggacaggucucgauuuuagugaccuguauuacuuaacuaugaacaauaaacacuggcuggugcauaaggaaugguuccacgauaucccacucccguggcacgcuggggccgacaccggcacaccccauuggaacaauaaagaggcacuuguagaauuuaaggaugcccacgcuaaacggcagaccguugugguccugggaagccaggagggcgcggugcauacugcauuggccggggcucuagaggccgaaauggacggagcaaagggucgacuguccucuggccaccucaaaugccgccugaagauggauaaacuuagacugaagggggucagcuauucauuguguacggccgcuuucacauuuaccaagaucccugccgagacucuccauggaaccgugacaguugaagugcaguacgcaggcaccgacgguccaugcaaaguacccgcgcaaauggcugucgacaugcagacucugacaccuguggggagguuaauuacggccaacccaguuauaaccgagaguacugaaaacuccaagaugaugcuggagcuagaucccccguucggcgacagcuacaucgugauuggagucggcgagaaaaagaucacacaccacuggcaucggucugggucaacccucggaaaggcauuuaguacaacucugaaaggugcccagcgccuugcugccuugggcgauaccgcaugggacuucgggagcauaggaggcguguucaauuccauugguagagcuguacaccaaguguuugggggcgccuucaggacgcuguuuggaggcaugucuuggaucacccaggggcucaugggagcgcugcuucuguggaugggcguuaacgcccgugaucggucgaucgcuuuggcauuccucgccacaggugggguccugguguuuuuagcuacuaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8282 - RNA, 2278 nt, Artificial Sequence
  ZIKV (strain MR 766) Polyprotein(108-690)-Cterm-JAEV1-E(400-500) mRNA Design 3 opt
gggagaaagcuuaccaugaccagcaucggcauuauagggcugcuccuuacaacugccauggcugcagagaucacgagaaggggauccgccuacuauauguaccuggaccggucugaugcggguaaggcuauuucauucgccaccacauugggcgugaacaaaugccacguccagaucauggacuuagggcauaugugugaugcaacuaugaguuaugaaugccccaugcuggacgagggaguugaaccugaugacguggauuguuggugcaauaccacaagcaccuggguaguguacggcacuugucaccauaagaaaggugaggcccgccgaucccguagagcugucacacuaccaucucacucgaccaggaagcuccaaacgcggucacagacuuggcuggaaagccgcgaguauaccaaacaucuuauuaagguggagaacuggaucuuuagaaauccgggguucgcacugguugccguggcuauagccugguugcucggaaguuccacaucucagaaggucaucuaccuggugaugauucugcucaucgcgcccgcauauagcauuaggugcaucggcguauccaaccgggacuuuguugaaggcaugucagggggaacuuggguggaugucguguuagagcacgguggcugugugaccgucauggcccaggacaaaccuacaguugauauagaacuggugaccacgacuguaaguaauauggcugaggugcgcagcuacugcuacgaggccucuauuuccgacauggcaucagauagccgauguccaacacaaggggaggcuuaucuugacaagcagagugacacccaguacgucugcaaaagaacuuugguggauaggggauggggcaacgguugugggcuguucggaaagggcucucuaguuacaugcgccaaauuuaccugcuccaagaagaugacgggcaaaagcauccagcccgaaaaucucgaauaucggauuaugcugucggugcacgggucucaacauuccggaaugaucgguuacgagaccgacgaagaucgugcgaaggucgaggugacaccuaacucaccacgcgccgaggcaacucuuggcggguucggaagucugggcuuggacugugaacccagaaccggucucgauuuuagcgaccuguauuacuuaacaaugaauaacaaacacuggcugguacauaaggagugguuccacgauaucccucucccauggcacgcuggggccgacacuggcaccccgcauuggaauaacaaagaagcucuuguugaguuuaaggaugcccacgcaaaaaggcagacaguggucgugcugggaucccaggaaggcgccguccauaccgcuuuggcgggggcacuagaggccgagauggacggagcuaagggucggcuguucucuggccaccucaagugccgacugaaaauggauaaacuucgccugaagggggugagcuauucauuguguacugccgcauuuacguucacaaagguucccgccgaaacccuccauggaacugugaccguagagguccaguacgcuggcacagacgguccuugcaaaauuccagugcaaauggccguugacaugcagacccugacucccguggggagauuaauaacagcaaauccugucaucacggaaaguaccgagaacuccaagaugaugcuggaacuagauccacccuuuggcgacagcuacauugugaucggaguaggcgauaagaaaauaacucaccacuggcauaggucugggucaacacucggaaaggcguucaguaccacacugaaaggugcucagcggcuugccgcauugggcgacacugccugggauuucgggagcauuggaggcguguuuaauuccaucggucgcgcuguucaccaagucuucgggggcgccuuuagaacccuguucggaggcaugucuuggaucacgcaggggcucaugggagcacugcuucuguggaugggcgugaacgcuagggaccguucgauugccuuggcguuucucgccaccgguggggugcuggucuucuuagcuacaaacguucaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8283 - RNA, 2290 nt, Artificial Sequence
  ZIKV (strain NatalRGN) Polyprotein(108-694)-Cterm-JAEV1-E(400-500) mRNA Design 3 opt
gggagaaagcuuaccaugaccagcgugggcaucgucgggcugcuccuuacaacugccauggcugcagagguuacgagaaggggauccgccuacuauauguaccuggaccggaacgaugcgggugaagcuauuucuuuccccaccacauugggcaugaauaagugcuauauacagaucauggacuuagggcacaugugugaugccacuaugucauacgagugcccuaugcuggacgaaggaguggagccagaugacguagauuguuggugcaacaccacaaguaccuggguggucuauggcacuugucaucacaaaaagggugaagcacgccgaagccguagagccgugacacuaccgucccauucuaccaggaaacuccaaacgcggucgcagacuuggcuggagucacgcgaguacaccaagcaccuuauuagaguugaaaauuggaucuuuaggaaccccggguucgcucuggcagccgcugccauugcgugguugcucggaagcaguacaucccagaaagugaucuaucuggucaugauacugcucaucgcacccgccuacucuauucggugcaucggcgugagcaaucgcgacuuuguagagggcauguccgggggaacuuggguugauguggucuuagaacaugguggcugugugaccgugauggcucaggacaagccaacagucgauauugagcugguuaccacgacugugucaaacauggccgagguacgaaguuacugcuaugaagcaagcaucucugacauggcuuccgauucaagaugucccacacaaggggaggccuaccuugacaagcagagcgacacccaguaugugugcaaaaggacuuuggucgaucggggauggggcaaugguugugggcuguucggaaagggcagucuagugacaugcgcgaaauuugccugcucuaagaaaaugaccggcaaguccauacagccugaaaaccucgaguaccguauuaugcugagcguucacgggucgcaacacucuggaaugaucgugaaugacacgggucaugaaaccgaugagaaccgcgcaaaggucgagauuacaccaaauucccccagagcugaagccacucuuggcggguucggaucacugggcuuggacugugagccuaggaccggucucgauuuuagugaccuguauuacuuaacaaugaacaauaaacacuggcuggugcauaaggaaugguuccacgauaucccacucccguggcacgcuggggccgacacuggcaccccucauuggaacaauaaagaggcacuuguagaauuuaaggaugcccacgcuaaacggcagacaguugugguccugggaagccaggagggcgcggugcauaccgcauuggccggggcucuagaggccgaaauggacggagcaaagggucgacuguccucuggccaccucaaaugccgccugaagauggauaaacuuagacugaagggggucagcuauucauuguguacugccgcuuucacguuuacaaagaucccugccgagacccuccauggaacugugaccguugaagugcaguacgcaggcacagacgguccaugcaaaguacccgcgcaaauggcugucgacaugcagacccugacuccuguggggagguuaauuacagccaacccaguuauaacggagaguaccgaaaacuccaagaugaugcuggagcuagaucccccguucggcgacagcuacaucgugauuggagucggcgagaaaaagaucacucaccacuggcaucggucugggucaacacucggaaaggcauuuaguaccacacugaaaggugcccagcgccuugcugccuugggcgauacugcaugggacuucgggagcauaggaggcguguucaauuccauugguagagcuguacaccaaguguuugggggcgccuucaggacccuguuuggaggcaugucuuggaucacgcaggggcucaugggagcgcugcuucuguggaugggcguuaacgcccgugaucggucgaucgcuuuggcauuccucgccaccggugggguccugguguuuuuagcuacaaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 8284 - RNA, 2365 nt, Artificial Sequence; identical to SEQ ID NO: 8261
  ZIKV (strain ZikaSPH2015) Polyprotein(93-804) mRNA Design 3 opt

SEQ ID NO: 8285 - RNA, 2362 nt, Artificial Sequence
  ZIKV prME variant mRNA Design 3 opt
gggagaaagcuuaccaugaucauuaacgccagaaaggagaaaaagaggcggggcgcugacaccagcguggggauagucggacugcuccuuacaacugcaauggccgcggaaguuacgcgccgagguuccgcuuacuauauguaccuggaucguaaugacgccggcgaggcaaucucuuuccccaccacauuggggaugaacaaaugcuauauucagaucauggauuuaggacacaugugugacgccacuaugucauacgaaugcccuaugcuggaugagggcguggaaccagacgauguagacuguuggugcaauaccacaaguaccuggguggucuaugguacuugucaucacaagaaaggggaggcuagaaggagccggcgcgcagugacacuaccgucccauucuaccagaaagcuccaaacgaggucgcagacuuggcuggagucacgggaauacaccaagcaccuuauucgcguugagaacuggaucuuucgaaaucccggauucgcccuggcugccgcggcaauagccugguugcucggcagcaguacaucccagaaagugaucuaucuggucaugauucugcucaucgcuccugccuacucuauuagaugcaucggcgugagcaacagggauuuuguagaagggauguccggagguacuuggguugacauaguguuagagcauggcgggugugucaccgugauggcacaggauaagccaacaguggacauugagcuggucaccacgacuguuucaaauauggcugaagugcggaguuacugcuaugaggccagcaucucugauauggcguccgacucacguugucccacacaaggagaagccuaccuugacaaacagagcgauacccaguauguaugcaagcgcacuuugguggacagaggcugggguaacggguguggacuguucggcaaaggcagucuagucacaugcgcaaaguuugcuugcucuaagaaaaugaccgggaaguccauucagccugagaaucucgaauacaggaucaugcugagcgugcacggaucgcaacacucugguaugaucguuaacgauacgggccaugagaccgacgagaaucgggccaaaguggaaauuacaccaaacucaccccgagcugaggccacucuugggggauucggcucccuggguuuggauugugaaccucgcaccgggcucgacuuuagugaucuguauuacuuaacaaugaauaacaagcacuggcugguccauaaagagugguuccacgacauaccacucccguggcacgcaggcgccgauacuggaacaccccauuggaauaacaaggaagcucuuguggaguuuaaagacgcgcacgcaaagagacagaccguaguugugcugggcagccaggagggggccguccauaccgcuuuggccggagcacuagaagccgagauggauggugcuaagggcaggcuguccucugggcaccucaaaugccggcugaagauggacaaacuucgccugaagggagugagcuauucauuguguacugccgcauucacguuuacaaaaaucccugcggaaacccuccauggcacugucaccguggagguucaguacgcugguacagacgggccaugcaaggugcccgcccaaauggcaguagauaugcagacccugacuccugucggcagauuaauuacagccaacccagugaucacggaaaguaccgaaaauuccaagaugaugcuggagcuagaucccccguucggagacagcuacauaguuauuggcgugggggagaaaaagaucacucaccacuggcauaggucuggaucaacaaucgguaaggcuuuugaggccaccguccguggcgcaaaacggauggcugugcucggggacacagccugggauuucggaaguguaggcggugcgcugaacagccuugggaaaggcauucaccagaucuucggagccgcuuuuaaguccuuguucggcgggaugucuugguuuucgcaaauucugauaggaacucuccugauguggcuuggccugaauaccaagaacgguagcaucuccuugaugugucucgcauuagggggagugcugauuuuccugucaacggccguuagugcugacgucggcugcucuguggauuuuagcaaaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
